United States Patent 12,508,308 (INFLUENZA mRNA VACCINES) - sequence listing, part 39

SEQ ID NO: 150487 - RNA, 1755 nt, Artificial Sequence
  derived and/or modified sequence opt3 from hemagglutinin__InfluenzaB__ALN39733
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcaccguugcaaccaaacaugcuuagaccgcaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagucacucucaugcuggcgaucuucauuguguauauggucagcagagacaaugugucuuguucaaucugccuuuga

SEQ ID NO: 150488 - RNA, 1755 nt, Artificial Sequence
  derived and/or modified sequence opt3 from hemagglutinin__InfluenzaB__ALN39751
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugguggccgguuggcacggcuacaccagucauggggcacacggagucgcuguggccgcugacuugaagucuacacaagaggccauaaacaagaucaccaaaaaucucaacucccugagcgaauuagagguaaagaaucugcagagacucucgggcgcaauggaugaacuucauaacgagauucuggaguuggacgaaaaaguugaugaccuaagggccgauacuaucucuucccagauagagcuggcugugcuccugucaaaugaagguauuaucaacagugaggacgaacaccuucuggcguuggagcggaagcucaaaaagaugcuggggcccagcgcagucgauaucggcaauggauguuucgagacgaagcacaaaugcaaccaaacaugcuuagaccguauugccgcuggcaccuuuaaugccggggaguucucccugccaacuuuugauucucuaaacaucaccgcagccagccucaaugacgauggacuggacaaccauacaauucuuuuguauuacucaaccgcugccaguucccuggcagugacucucaugcuggcgcuuuucauagucuauauggugagccgcgacaauguuucuuguucaaucugccuguga

SEQ ID NO: 150489 - RNA, 1755 nt, Artificial Sequence; identical to SEQ ID NO: 150464
  derived and/or modified sequence opt3 from hemagglutinin__InfluenzaB__ALN39752

SEQ ID NO: 150490 - RNA, 1755 nt, Artificial Sequence; identical to SEQ ID NO: 150305
  derived and/or modified sequence opt3 from hemagglutinin__InfluenzaB__ALN39753

SEQ ID NO: 150491 - RNA, 1758 nt, Artificial Sequence
  derived and/or modified sequence opt3 from hemagglutinin__InfluenzaB__ALN39754
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacguacgguugucgacacauaacguuaucaaugccgaggacgcaccagggggacccuauaagauuggcacuucaggcagcugcccuaacaucaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgacuugaagaguacccaggaggcuauaaauaaaauuacuaagaaccucaauucucuguccgaauuagaggucaaaaaccugcagcgacucagcggggccauggaugagcuucauaaugaaauccuggaguuggacgaaaagguggacgaucuaagagcagacacgaucucgucucaaauugagcuggccguacuccuguccaacgaaggcaucauuaauucagaggaugagcaccuucuggcuuuggaaaggaaacucaagaagaugcugggaccuagugcgguugagauaggcaacggguguuucgaaacaaaacauaagugcaaucagaccugcuuagaccggaucgcagccggaacuuuugaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgugacaaugugagcuguucuauaugccuguga

SEQ ID NO: 150492 - RNA, 1758 nt, Artificial Sequence
  derived and/or modified sequence opt3 from hemagglutinin__InfluenzaB__ALN39755
augaaggccaucauugugcugcuccuugucguuaccagcaacgcugacagaauaugcacaggcaucacuuccucuaauucaccccacgugguaaaaacggcaacccagggggaggugaacgucacaggagugauuccucugacuaccacaccaaccaagagucauuucgccaauuugaaagguacugaaacaaggggcaaguuauguccgaaaugccugaacuguaccgaucuagacguugcgcucgggcggcccaagugcacgggaaagaucccuagcgcucgcguguccauucugcacgagguccgaccagugacuucuggcuguuuucccaucaugcaugaucguaccaaaauaagacaacuuccuaaucuguugagggguuacgaacacguacggcucucgacacauaacguuaucaaugccgaggacgcaccagggggacccuauaagauuggcacuucaggcagcugcccuaacaucaccaaugggaacggauucuuugccacaauggcuugggcagugccgaaaaaugauaagaacaaaaccgccacgaauccacugacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacucccccagucaggccgcaucguuguggacuauaugguacagaagaguggcaaaacagggacuauuaccuaccaaagaggaaucuuacugccucagaagguguggugcgcgagcgguaggucuaaagucaucaagggcucccuuccauugauuggggaagcagauugucugcaugagaaauauggaggccuaaacaagucaaagcccuacuacacaggugagcacgccaaagcuauagggaauugcccgaucugggugaagacuccucucaaacuggccaacggcaccaaguaucggcccccagcaaaacuucugaaggaacgcggauuuuucggcgcuauugccggguuuuuggagggagguugggaaggcaugaucgcgggguggcauggauacacaagccacggcgcccacgguguugcaguggcugccgaccucaagaguacccaggaggcuauaaauaaaauuacuaagaacuuaaauucucuguccgaacuggaggucaaaaaccuccagcgacuuagcggggccauggaugagcugcauaaugaaaucuuggagcuagacgaaaagguggacgaucugagagcagacacgaucucgucucaaauugagcucgccguacugcuuuccaacgaaggcaucauuaauucagaggaugagcaccuguuggcucucgaaaggaaacugaagaagauguuaggaccuagugcgguugagauaggcaacggguguuucgaaacaaaacauaagugcaaucagaccugccuggaccggaucgcagccggaacuuuugaugcuggugaguucagccuacccaccuuugacucccucaacauuacagccgcaucucugaaugaugacggccuugauaaccacaccaucuugcuguauuacagcacugccgcuucaagucucgccgugacacugaugaucgcaauuuucgucguguauauggucucccgugacaaugugagcuguucuauaugccuuuga

SEQ ID NO: 150493 - RNA, 1755 nt, Artificial Sequence
  derived and/or modified sequence opt3 from hemagglutinin__InfluenzaB__ALN39756
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcacaaaugcaaccaaacaugcuuagaccguaucgccgcuggcaccuuuaaugucggggaguucucccugccaacuuuugauucucuaaacauuaccgccgcaagccucaaugacgauggacuggacaaccauacaauacuuuuguauuacucaaccgccgcuaguucccuggccgugacucucaugcuggcaaucuucauugucuauauggugagccgcgacaauguuucuuguucaaucugccuuuga

SEQ ID NO: 150494 - RNA, 1758 nt, Artificial Sequence; identical to SEQ ID NO: 150491
  derived and/or modified sequence opt3 from hemagglutinin__InfluenzaB__ALN39757

SEQ ID NO: 150495 - RNA, 1755 nt, Artificial Sequence; identical to SEQ ID NO: 150305
  derived and/or modified sequence opt3 from hemagglutinin__InfluenzaB__ALN39758

SEQ ID NO: 150496 - RNA, 1755 nt, Artificial Sequence
  derived and/or modified sequence opt3 from hemagglutinin__InfluenzaB__ALN39759
augaagaccaucauugugcugcucauggucguuacaagcaacgccgacagaauaugcacuggcaucacguccucuaauucaccccacgugguaaaaaccgcuacacagggggaagugaacgucacuggagugauuccucuuaccacaaccccaacuaagaguuacuucgcaaaucugaaagguacaaggacccggggcaaguuguguccggauugcuuaaacuguacggaccuggauguugcccuagggcgccccaugugcgugggaacuaccccuagcgcgaaggcuuccauccuccaugaaguccgaccagugacaucuggcuguuuucccauuaugcacgaccguacuaaaaucagacaacugccuaaucuucugagggguuaugagaagauacgguugucgacccagaacguaaucgaugccgaaaaagcaccagggggacccuaccgccucggcacaucaggcagcugcccuaaugccaccaguaagauuggguucuuugcuacgauggcaugggccguuccaaaagacaacuauaagaaugcuacuaacccgcagacaguggagguccccuacaucuguaccgaaggagaggaucagauuacugugugggguuuccauuccgacaauaaaacacaaaugaagucucuguauggcgauagcaacccucagaaguuuaccuccucagccaauggggugacgacccacuacgucagucagaucggagacuucccagaucagacagaggacggcggucugccccaaagcgggagaauaguuguggauuauaugaugcagaaaccuggaaagacuggcaccauuguauaccagaggggcgugcucuuaccacagaaagucuggugcgcgucugggcgguccaaggugaucaaaggaucacugccccuuauuggugaagcagacuguuugcaugaggaauacggcgggcugaacaagagcaaaccguauuacacaggaaagcacgccaaggcuaucggcaauugcccuaucuggguuaaaacuccccuaaagcucgccaacgguaccaaauaucgcccuccagcaaagcugcuuaaagagcgaggguuuuucggcgcuauugccggauuucuggagggcgggugggaaggaaugauagcggguuggcacggcuacacaagucauggggcccacggaguggcagucgcugccgacuugaagucuacccaagaggcuaucaacaagauuacuaaaaaucucaacucccugagcgaauuagaggugaagaaucugcagagacucucgggcgccauggaugaacuucauaacgagauccuggaguuggacgaaaaaguagaugaccuaagggcagauacgauaucuucccagauugagcuggccguucuccugucaaaugaagguaucaucaacagugaggacgaacaccuucuggcuuuggagcggaagcucaaaaagaugcuggggcccagcgcgguggauauuggcaauggauguuucgagacaaagcacaaaugcaaccaaaccugcuuagaccguaucgcagccggcacuuuuaaugcuggggaguucucccugccaaccuuugauucucuaaacauuacagccgcaagccucaaugacgauggacuggacaaccauaccauacuuuuguauuacucaacugccgcuaguucccuggccgucacacucaugcuggcaaucuucauuguguauauggucagccgcgacaaugugucuuguucaaucugccuuuga

SEQ ID NO: 150497 - RNA, 1758 nt, Artificial Sequence; identical to SEQ ID NO: 150455
  derived and/or modified sequence opt3 from hemagglutinin__InfluenzaB__ALN39760

SEQ ID NO: 150498 - RNA, 1755 nt, Artificial Sequence; identical to SEQ ID NO: 150305
  derived and/or modified sequence opt3 from hemagglutinin__InfluenzaB__ALN39761

SEQ ID NO: 150499 - RNA, 1755 nt, Artificial Sequence; identical to SEQ ID NO: 150305
  derived and/or modified sequence opt3 from hemagglutinin__InfluenzaB__ALN39762

SEQ ID NO: 150500 - RNA, 1755 nt, Artificial Sequence; identical to SEQ ID NO: 150305
  derived and/or modified sequence opt3 from hemagglutinin__InfluenzaB__ALN39763

SEQ ID NO: 150501 - RNA, 1758 nt, Artificial Sequence; identical to SEQ ID NO: 150491
  derived and/or modified sequence opt3 from hemagglutinin__InfluenzaB__ALN39764

SEQ ID NO: 150502 - RNA, 1755 nt, Artificial Sequence
  derived and/or modified sequence opt3 from hemagglutinin__InfluenzaB__ALN39765
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaauaaccugcagagacucucgggcgcaauggaugaacuucauaaugagauccuggaguuggacgaaaagguagaugaccuaagggccgauacuauaucuucccagauugagcuggcuguucuccugucaaacgaagguaucaucaauagugaggacgaacaccuucuggcguuggagcggaaacucaagaaaaugcuggggcccagcgcaguggauauuggcaacggauguuucgagacgaagcacaagugcaaucaaacaugcuuagaccguaucgccgcuggcaccuuuaacgccggggaguucucccugccaacuuuugauucucuaaauauuaccgcagccagccucaacgacgauggacuggacaaucauacaauacuuuuguauuacucaaccgcugccaguucccuggcagucacucucaugcuggcgcuuuucaucguguauauggucagccgcgacaacgugucuuguucaauuugccuguga

SEQ ID NO: 150503 - RNA, 1755 nt, Artificial Sequence; identical to SEQ ID NO: 150468
  derived and/or modified sequence opt3 from hemagglutinin__InfluenzaB__ALN39766

SEQ ID NO: 150504 - RNA, 1755 nt, Artificial Sequence; identical to SEQ ID NO: 150305
  derived and/or modified sequence opt3 from hemagglutinin__InfluenzaB__ALN39767

SEQ ID NO: 150505 - RNA, 1755 nt, Artificial Sequence; identical to SEQ ID NO: 150468
  derived and/or modified sequence opt3 from hemagglutinin__InfluenzaB__ALN39768

SEQ ID NO: 150506 - RNA, 1755 nt, Artificial Sequence
  derived and/or modified sequence opt3 from hemagglutinin__InfluenzaB__ALN39769
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacggucguacaaagaucagacaacugccuaaucuucugaggggguaugagaagauacgguugucgacucagaacguaaucgacgcagaaaaagccccaggaggccccuaccgccucggcaccucagggagcugcccuaaugcuacaaguaagauuggauucuuugcaaccauggccugggcuguuccaaaagauaacuauaagaaugccacgaacccgcagacuguggagguccccuacaucuguacagaaggugaggaccagauuaccguguggggcuuccauuccgauaauaaaacucaaaugaagucucuguauggggacagcaacccucagaaguuuacauccucagcgaauggagugaccacgcacuacgucagucagaucggcgauuucccagaccagaccgaggauggugggcugccccaaagcggaagaauaguuguggacuauaugaugcagaaaccuggcaagacaggcacuauuguauaccagaggggagugcucuuaccacagaaagucuggugcgcaucugggcgguccaaggugaucaaagguucacugccccuuauuggcgaagccgauuguuugcaugaggaauacgggggacugaacaagagcaaaccguauuacaccggcaagcacgcuaaggccaucgguaauugcccuaucuggguuaaaacaccccuaaagcucgcaaacgggacuaaauaucgcccuccagcuaagcugcuuaaagagcgaggcuuuuucggagccauugcgggcuuucuggaagggggaugggaagguaugauagccggcuggcacggguacaccagucauggagcacacggcguggcugucgccgcugacuugaagucuacacaagaggccaucaacaagauuaccaaaaaucucaacucccugagcgaauuagaggugaagaaucugcagagacucucgggugcaauggacgaacuucauaacgagauccuggaguuggaugaaaaaguagacgaucuaagggccgacacuauaucuucccagauugagcuggcuguucuccugucaaaugaagggaucaucaacagugaggaugaacaccuucuggcguuggagcggaagcucaaaaagaugcugggccccagcgcaguggacauuggaaauggcuguuucgagacgaagcacaaaugcaaccaaacaugcuuagaucguaucgccgcugggaccuuuaaugccggagaguucucccugccaacuuuugacucucuaaacauuaccgcagccagccucaaugaugacggucuggauaaccauacaauacuuuuguauuacucaaccgcugccaguucccuggcagucacucucaugcuggcgaucuucauuguguauauggucagccgcgacaaugugucuuguucaaucugccuuuga

SEQ ID NO: 150507 - RNA, 1755 nt, Artificial Sequence; identical to SEQ ID NO: 150464
  derived and/or modified sequence opt3 from hemagglutinin__InfluenzaB__ALN39770

SEQ ID NO: 150508 - RNA, 1755 nt, Artificial Sequence; identical to SEQ ID NO: 150464
  derived and/or modified sequence opt3 from hemagglutinin__InfluenzaB__ALN39771

SEQ ID NO: 150509 - RNA, 1755 nt, Artificial Sequence; identical to SEQ ID NO: 150305
  derived and/or modified sequence opt3 from hemagglutinin__InfluenzaB__ALN39773

SEQ ID NO: 150510 - RNA, 1755 nt, Artificial Sequence; identical to SEQ ID NO: 150305
  derived and/or modified sequence opt3 from hemagglutinin__InfluenzaB__ALN39774

SEQ ID NO: 150511 - RNA, 1758 nt, Artificial Sequence
  derived and/or modified sequence opt3 from hemagglutinin__InfluenzaB__ALN39775
augcaggccaucauugugcugcucauggucguuaccagcaacgcugacagaauaugcacaggcaucacuuccucuaauucaccccacgugguaaagacggcaacccaaggggaggugaacgucacaggagugauuccucuuacuaccacaccaaccaaaagucauuucgccaaucugaaggguacugaaacaaggggcaaauuguguccgaagugcuuaaacuguaccgaucuggacguugcgcuagggcggcccaaaugcacgggaaagaucccuagcgcucgcguguccauucuccacgagguccgaccagugacuucuggcuguuuucccaucaugcaugaucguaccaagauaagacagcugccuaaucuucugagggguuacgaacacauccgguugucgacacauaacguaauuaaugccgaggacgcaccagggggacccuauaaaaucggcacuucaggcagcugcccuaacauuaccaaugggaacggauucuuugccacaauggcuugggcaguuccaaagaaugauaaaaacaagaccgccacgaauccgcucacuaucgaagugcccuacauauguacagagggugaggaccagauuaccgucuggggcuuccacagugauaacgaaacucagauggcuaaacuguauggggacuccaagccucaaaaguuuacaucuagcgccaauggagugaccacgcacuacgugucccagaucggcgguuucccaaaccagaccgaggaugggggacugccccagucaggccgcauugucaucgacuauaugguucagaaaaguggcaagacagggacuaucaccuaccaaagagguauucucuuaccucagaaaguguggugcguaagcggaaggucuaaggugauaaaaggcucccugccacuuaucggggaagcggauuguuugcaugagaaguauggaggccugaacaaaucaaagcccuacuacacaggugagcacgcaaaggccgucgggaauugcccgauuugggugaaaacuccucuaaagcucgcuaacggcaccaaauaucggcccccagccaagcugcuuaaagaacgcggauuuuucggcgcaaucgcuggguuucuggagggagguugggaaggcaugauagccggguggcauggauacacaagccacggcgcgcacgguguugccguggcagcugacuugaagaguacccaggaggccauuaauaagaucacuaaaaaccucaauucucuguccgaauuagaggucaagaaccugcaacgacucagcggggcuauggaugagcuucauaaugaaauccuggaguuggacgaaaaaguggacgaucuaagagccgacacgauuucgucucagaucgagcuggcaguacuccuguccaacgaaggcauuauaaauucagaggaugagcaccuucuggccuuggaaaggaagcucaaaaagaugcugggaccuagugcuguugagaucggcaacggguguuucgaaacaaagcauaaaugcaaucagaccugcuuagaccggauugcggcaggaacuuuugaugccggugaguucagccugcccaccuuugacucccuaaacaucacagcugccucucucaaugaugacggccuggauaaccacaccauccuuuuguauuacagcacugcagccucaagucuggcugugacacucaugauugccauauucgucguguauauggucucccgugacaaugugagcuguucuaucugccuguga

SEQ ID NO: 150512 - RNA, 1755 nt, Artificial Sequence
  derived and/or modified sequence opt3 from hemagglutinin__InfluenzaB__ALN39776
augaaggccaucauuauacugcucaugguggucaccagcaacgcugacagaaucugcacaggcauuacuuccucuaauucaccccacguugugaaaacggcaacccagggggaaguaaacgugacaggagucaucccucuuacuaccacaccaaccaagaguuacuucgccaaucugaaagguacuaggacacggggcaaguuguguccggauugcuuaaacuguaccgaccuggauguggcgcuagggcgccccaugugcguuggaacgacuccuagcgcuaaagccuccauucuccaugaagugcgaccagucaccucuggcuguuuucccaucaugcacgaccguacaaagauaagacaacugccuaaucuucugagggguuaugagaagauccgguugucgacucagaacgugauugaugcagaaaaagccccagggggacccuaccgccucggcaccucaggcagcugcccuaaugcuacaaguaagaucggguucuuugcaaccauggccugggcuguaccaaaagacaacuauaagaaugccacgaacccgcagacuguugaggugcccuacauuuguacagaaggagaggaucagaucaccgucugggguuuccauuccgacaauaaaacucaaaugaagucucuguauggcgauagcaacccucagaaguuuacauccucagcgaauggggugaccacgcacuacgugagucagauaggagacuucccagaucagaccgaggacggcggucugccccaaagcgggagaauugucguugauuauaugaugcagaaaccuggaaagacaggcacuaucguguaccagaggggcguacucuuaccacagaaaguguggugcgcaucugggcgguccaaggucauuaaaggaucacugccccuuaucggugaagccgacuguuugcaugaggaauacggcgggcugaacaagagcaaaccguauuacaccggaaagcacgcuaaggccaucggcaauugcccuauuugggugaaaacaccccuaaagcucgcaaacgguacuaaauaucgcccuccagcuaagcugcuuaaagagcgaggguuuuucggcgccauagcgggauuucuggagggcgggugggaaggaaugaucgccgguuggcacggcuacaccagucauggggcacacggaguugcuguggccgcugacuugaagucuacacaagaggccauuaacaagaucaccaaaaaucucaacucccugagcgaauuagaggucaagaaucugcagagacucucgggcgcaauggaugaacuucauaacgagauacuggaguuggacgaaaaaguggaugaccuaagggccgauacuauuucuucccagaucgagcuggcuguacuccugucaaaugaagguaucauuaacagugaggacgaacaccuucuggcguuggagcggaagcucaaaaagaugcuggggcccagcgcaguugauaucggcaauggauguuucgagacgaagcacaaaugcaaccaaacaugcuuagaccguauugccgcuggcaccuuuaaugccggggaguucucccugccaacuuuugauucucuaaacauaaccgcagccagccucaaugacgauggacuggacaaccauacaauccuuuuguauuacucaaccgcugccaguucccuggcagugacucucaugcuggcgauuuucaucgucuauauggugagccgcgacaaugucucuuguucaaucugccuuuga

SEQ ID NO: 150513 - RNA, 1755 nt, Artificial Sequence; identical to SEQ ID NO: 150468
  derived and/or modified sequence opt3 from hemagglutinin__InfluenzaB__ALN39778

SEQ ID NO: 150514 - RNA, 1758 nt, Artificial Sequence; identical to SEQ ID NO: 150491
  derived and/or modified sequence opt3 from hemagglutinin__InfluenzaB__ALN39779

SEQ ID NO: 150515 - RNA, 1755 nt, Artificial Sequence; identical to SEQ ID NO: 150305
  derived and/or modified sequence opt3 from hemagglutinin__InfluenzaB__ALN39780

SEQ ID NO: 150516 - RNA, 1758 nt, Artificial Sequence; identical to SEQ ID NO: 150491
  derived and/or modified sequence opt3 from hemagglutinin__InfluenzaB__ALN39781

SEQ ID NO: 150517 - RNA, 1758 nt, Artificial Sequence; identical to SEQ ID NO: 150455
  derived and/or modified sequence opt3 from hemagglutinin__InfluenzaB__ALN39782

SEQ ID NO: 150518 - RNA, 1755 nt, Artificial Sequence
  derived and/or modified sequence opt3 from hemagglutinin__InfluenzaB__ALN39783
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaaccugcagacuguggaggucccguacaucuguacagaaggagaggaucagauuaccgugugggguuuccauuccgacaauaaaacucaaaugaagucucuguauggcgauagcaacccccagaaguuuacauccucagcgaauggggugaccacgcacuacgucagucagaucggagacuucccugaucagaccgaggacggcggucucccacaaagcgggagaauaguuguggauuauaugguacagaaacccggaaagacaggcacuauuguguaccagaggggcgucuuacugccucagaaaguguggugcgcaucugggcgguccaagguuaucaaaggaucacuuccauugauuggugaagccgacugucugcaugaggaauacggcgggcuaaacaagagcaaacccuauuacaccggaaagcacgcuaaggccaucggcaauugcccgaucugggugaaaacaccucucaagcuggcaaacgguacuaaauaucgacccccagcuaaacuucugaaggagcgcggguuuuucggcgccauugcgggauuuuuggagggcgggugggaaggaaugauagccgguuggcacggcuacaccagucauggggcacacggagucgcuguggccgcugaccucaagucuacacaagaggccaucaacaagauuaccaaaaaucugaacuccuuaagcgaacuggagguaaagaaucuccagagacuuucgggcgcaauggaugaacugcauaacgagaucuuggagcuagacgaaaaaguugaugaccugagggccgauacuauaucuucccagauugagcucgcugugcugcuuucaaaugaagguaucaucaacagugaggacgaacaccuguuggcgcucgagcggaagcugaaaaagauguuagggccuagcgcagucgauauuggcaauggauguuucgagacgaagcacaaaugcaaccaaacaugccuggaccguaucgccgcuggcaccuuuaaugccggggaguucucccuacccacuuuugauucucucaacauuaccgcagccagccugaaugacgauggacuugacaaccauacaauauugcuguauuacucaaccgcugccaguucccucgcagugacucugaugcuugcgaucuucauugucuauauggugagccgcgacaauguuucuuguucaaucugccuguga

SEQ ID NO: 150519 - RNA, 1758 nt, Artificial Sequence; identical to SEQ ID NO: 150467
  derived and/or modified sequence opt3 from hemagglutinin__InfluenzaB__ALN39784

SEQ ID NO: 150520 - RNA, 1758 nt, Artificial Sequence; identical to SEQ ID NO: 150491
  derived and/or modified sequence opt3 from hemagglutinin__InfluenzaB__ALN39785

SEQ ID NO: 150521 - RNA, 1755 nt, Artificial Sequence; identical to SEQ ID NO: 150305
  derived and/or modified sequence opt3 from hemagglutinin__InfluenzaB__ALN39786

SEQ ID NO: 150522 - RNA, 1758 nt, Artificial Sequence; identical to SEQ ID NO: 150491
  derived and/or modified sequence opt3 from hemagglutinin__InfluenzaB__ALN39787

SEQ ID NO: 150523 - RNA, 1758 nt, Artificial Sequence; identical to SEQ ID NO: 150491
  derived and/or modified sequence opt3 from hemagglutinin__InfluenzaB__ALN39788

SEQ ID NO: 150524 - RNA, 1755 nt, Artificial Sequence
  derived and/or modified sequence opt3 from hemagglutinin__InfluenzaB__ALN39790
augaaggccaucauugugcugcucauggucguuaccagcgacgcugauagaauaugcacaggcaucacuuccucuaacucaccccacgugguaaaaacggcaacccagggggaagugaaugucacaggagugauuccucuuacuaccacaccaaccaagaguuacuucgccaaccugaaagguacuaggacacggggcaaguuguguccggacugcuuaaauuguaccgaucuggacguugcgcuagggcgccccaugugcgugggaacgacuccuagcgcuaaagccuccauccuccaugaaguccgaccagugaccucuggcuguuuucccauuaugcacgaucguacaaagaucagacaacugccuaaccuucugagggguuaugagaagauacgguugucgacucagaauguaaucgacgcagaaaaagccccagggggacccuaccgccucggcaccucaggcagcugcccuaacgcuacaaguaagauuggguucuuugcaaccauggccugggcuguuccaaaagauaauuauaagaacgccacgaauccgcagacuguggagguccccuacaucuguacagaaggagaggaccagauuaccgugugggguuuccauuccgauaacaaaacucaaaugaagucucuguauggcgacagcaauccucagagauuuacauccucagcgaacggggugaccacgcacuacgucagucagaucggagauuucccagaccagaccgaggauggcggucugccccaaagcgggaggauaguuguggacuauaugguacagaagccuggaaaaacaggcacuauuguguaccagcggggcguccucuuaccacagaagguguggugcgcaucugggcgcuccaaaguuaucaagggaucacugccccuuauuggugaagccgacuguuugcaugaggaauacggcgggcugaauaaaagcaagccguauuacaccggaaaacacgcuaaggccaucggcaacugcccuaucugggugaagacaccccuaaaacucgcaaaugguacuaaguaucgaccuccagcuaaacugcuuaaggagagaggguuuuucggcgccauugcgggauuucuggagggcgggugggaaggaaugauagccgguuggcacggcuacaccagucauggggcacacggagucgcuguggccgcugauuugaaaucuacacaagaggccaucaacaagauuaccaagaaccucaauucccugagcgaauuagagguuaaaaaccugcagaggcucucgggcgcaauggacgaacuucauaaugagauccuggaguuggaugaaaagguagacgaucuacgggccgacacuauaucuucccagauugagcuggcugugcuccugucaaacgaagguaucaucaauagugaggaugaacaccuucuggcguuggagcguaaacucaagaaaaugcuggggcccagcgcagucgacauuggcaacggauguuucgagacgaagcacaagugcaaucaaacaugcuuagaucgcaucgccgcuggcaccuuuaacgccggggaguucucccugccaacuuuugacucucuaaauauuaccgcagccagccucaacgaugacggacuggacaaucauacaauacuuuuguauuacucaaccgcugccaguucccuggcagugacucucaugcuggcgaucuucauugucuauauggugagcagagauaacguuucuuguucaaucugccuuuga

SEQ ID NO: 150525 - RNA, 1755 nt, Artificial Sequence
  derived and/or modified sequence opt3 from hemagglutinin__InfluenzaB__ALN39791
augaaggccaucauugugcugcucauggucguuaugagcaacgcugacagaauaugcaccggcaucacauccucuaauucaccccacgugguaaaaacugcaacgcagggggaagugaacgucaccggagugauuccucuuacaacuaccccaacaaagaguuacuucgccaaucugaaagguaccaggacucggggcaaguuguguccggauugcuuaaacuguacagaccuggauguugcgcuagggcgccccaugugcgugggaaccacgccuagcgcuaaagccuccauccuccaugaaguccgaccagugacuucuggcuguuuucccauuaugcacgaccguaccaagaucagacaacugccuaaucuucugagggguuaugagaagauacgguugucgacacagaacguaaucgaugcagaaaaagccccagggggacccuaccgccucggcacuucaggcagcugcccuaaugcuaccaguaagauuggguucuuugcaacaauggccugggcuguuccaaaagacaacuauaagaaugccaccaacccgcagacgguggagguccccuacaucuguacugaaggagaggaucagauuacagugugggguuuccauuccgacaauaaaacccaaaugaagucucuguauggcgauagcaacccucagaaguuuacuuccucagcgaauggggugacaacccacuacgucagucagaucggagacuucccagaucagacggaggacggcggucugccccaaagcgggagaauaguuguggauuauaugguacagaaaccuggaaagaccggcacaauuguguaccagaggggcguccucuuaccacagaaaguguggugcgcaucugggcgguccaagguuaucaaaggaucacugccccuuauuggugaagccgacuguuugcaugaggaauacggcgggcugaacaagagcaaaccguauuacacuggaaagcacgcuaaggccaucggcaauugcccuaucugggugaaaaccccucuaaagcucgcaaacgguacaaaauaucgcccacccgcuaagcugcuuaaagagcgaggguuuuucggcgccauugcgggauuucuggagggcgggugggaaggaaugauagccgguuggcacggcuacacaagucauggggcacacggagucgcuguggccgcugacuugaagucuacccaagaggccaucaacaagauuacuaaaaaucucaacucccugagcgaauuagagguaaagaaucugcagagacucucgggcgcaauggaugaacuucauaacgagauccuggaguuggacgaaaaaguugaugaccuaagggccgauaccauaucuucccagauugagcuggcugugcuccugucaaaugaagguaucaucaacagugaggacgaacaccuucuggcguuggagcggaagcucaaaaagaugcuggggcccagcgcagucgauauuggcaauggauguuucgagacuaagcacaaaugcaaccaaacgugcuuagaccguaucgccgcuggcacauuuaaugccggggaguucucccugccaaccuuugauucucuaaacauuacugcagccagccucaaugacgauggacuggacaaccauaccauacuuuuguauuacucaacagcugccaguucccuggcagugacccucaugcuggcgaucuucauugucuauauggugagccgcgacaauguuucuuguucaaucugccuuuga

SEQ ID NO: 150526 - RNA, 1758 nt, Artificial Sequence; identical to SEQ ID NO: 150491
  derived and/or modified sequence opt3 from hemagglutinin__InfluenzaB__ALN39792

SEQ ID NO: 150527 - RNA, 1758 nt, Artificial Sequence; identical to SEQ ID NO: 150491
  derived and/or modified sequence opt3 from hemagglutinin__InfluenzaB__ALN39793

SEQ ID NO: 150528 - RNA, 1755 nt, Artificial Sequence
  derived and/or modified sequence opt3 from hemagglutinin__InfluenzaB__ALN39794
augaaggccaucauuauacugcucaugguggucaccagcaacgcugacagaaucugcacaggcauuacuuccucuaauucaccccacguugugaaaacggcaacccagggggaaguaaacgugacaggagucaucccucuuacuaccacaccaaccaagaguuacuucgccaaucugaaagguacuaggacacggggcaaguuguguccggauugcuuaaacuguaccgaccuggauguggcgcuagggcgccccaugugcguuggaacgacuccuagcgcuaaagccuccauucuccaugaagugcgaccagucaccucuggcuguuuucccaucaugcacgaccguacaaagauaagacaacugccuaaucuucugagggguuaugagaagauccgguugucgacucagaacgugauugaugcagaaaaagccccagggggacccuaccgccucggcaccucaggcagcugcccuaaugcuacaaguaagaucggguucuuugcaaccauggccugggcuguaccaaaagacaacuauaagaaugccacgaacccgcagacuguugaggugcccuacauuuguacagaaggagaggaucagaucaccgucugggguuuccauuccgacaauaaaacucaaaugaagucucuguauggcgauagcaacccucagaaguuuacauccucagcggacggggugaccacgcacuacgugagucagauaggagauuucccagaccagaccgaggauggcggucugccccaaagcgggagaauugucguugacuauaugaugcagaaaccuggaaagacaggcacuaucguguaccagaggggcguacucuuaccacagaaaguguggugcgcaucugggcgguccaaggucauuaaaggaucacugccccuuaucggugaagccgacuguuugcaugaggaauacggcgggcugaauaagagcaaaccguauuacaccggaaagcacgcuaaggccaucggcaacugcccuauuugggugaaaacaccccuaaagcucgcaaaugguacuaaauaucgcccuccagcuaagcugcuuaaagagcgaggguuuuucggcgccauagcgggauuucuggagggcgggugggaaggaaugaucgccgguuggcacggcuacaccagucauggggcacacggaguugcuguggccgcugauuugaagucuacacaagaggccauuaacaagaucaccaaaaaccucaauucccugagcgaauuagaggucaagaaccugcagagacucucgggcgcaauggacgaacuucauaaugagauacuggaguuggaugaaaaaguggacgaucuaagggccgacacuauuucuucccagaucgagcuggcuguacuccugucaaacgaagguaucauuaauagugaggaugaacaccuucuggcguuggagcggaagcucaaaaagaugcuggggcccagcgcaguugacaucggcaacggauguuucgagacgaagcacaaaugcaaucaaacaugcuuagaucguauugccgcuggcaccuuuaacgccggggaguucucccugccaacuuuugacucucuaaauauaaccgcagccagccucaacgaugacggacuggacaaucauacaauccuuuuguauuacucaaccgcugccaguucccuggcagugacucucaugcuggcgauuuucaucgucuauauggugagccgcgauaacgucucuuguucaaucugccuuuga

SEQ ID NO: 150529 - RNA, 1755 nt, Artificial Sequence; identical to SEQ ID NO: 150468
  derived and/or modified sequence opt3 from hemagglutinin__InfluenzaB__ALN39795

SEQ ID NO: 150530 - RNA, 1758 nt, Artificial Sequence
  derived and/or modified sequence opt3 from hemagglutinin__InfluenzaB__ALN39796
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacgccaccaaugggaacggauucuuugcuacaauggcaugggccguuccgaaaaaugauaagaacaaaaccgcuacgaauccacucacuauugaagugcccuacaucuguacagagggugaggaccagauaaccgucuggggcuuccacagugauaacgaaacucagauggccaagcuguauggggacuccaagccucagaaauuuacaucuagcgcgaauggagugaccacgcacuacgugucccaaauuggcgguuucccaaaccagaccgaggaugggggacugccccagucaggccgcaucgucguugacuauauggugcagaagaguggcaaaacagggacuauuaccuaccaaagaggaauccucuuaccucagaagguauggugcgcaagcgguaggucuaaagugaucaagggcucccugccacuuauuggggaagccgauuguuugcaugagaaauauggaggccugaacaagucaaagcccuacuacacaggugagcacgcuaaagccauagggaauugcccgaucugggucaagacuccucuaaaacucgcaaacggcaccaaguaucggcccccagcuaaacugcuuaaggaacgcggauuuuucggcgccauugcgggguuucuggagggagguugggaaggcaugaucgccggguggcauggauacacaagccacggcgcacacgguguggcuguugccgcugacuugaagaguacccaggaggccauaaauaaaauuacuaagaaccucaauucucuguccgaauuagaggugaaaaaccugcagcgacucagcggggcaauggaugagcuucauaaugaaauccuggaguuggacgaaaaggucgacgaucuaagagccgacacgaucucgucucaaauugagcuggcugugcuccuguccaacgaaggcaucauuaauucagaggaugagcaccuucuggcguuggaaaggaaacucaagaagaugcugggaccuagugcaguagagauaggcaacggguguuucgaaacaaaacauaagugcaaucagaccugcuuagaccggaucgccgcuggaacuuuugaugccggugaguucagccugcccaccuuugacucccuaaacauuacagcagccucucucaaugaugacggccuggauaaccacaccauccuuuuguauuacagcacugcugccucaagucuggcaguuacacucaugaucgcgauuuucguggucuauauggugucccgugacaaugucagcuguucuauaugccuguga

SEQ ID NO: 150531 - RNA, 1755 nt, Artificial Sequence; identical to SEQ ID NO: 150468
  derived and/or modified sequence opt3 from hemagglutinin__InfluenzaB__ALN39797

SEQ ID NO: 150532 - RNA, 1755 nt, Artificial Sequence
  derived and/or modified sequence opt3 from hemagglutinin__InfluenzaB__ALN39798
augaaggccaucauugugcugcucauggucguuaccagcaacgcugacagaauaugcacaggcaucacuuccucuucaaguccccacgugguaaaaacggcaacccagggggaagugaaugucacaggagugauuccucuuacuaccacaccaaccaagagcuacuucgccaaccugaaagguacuaggacacggggcaaguuguguccggauugcuuaaauuguaccgaccuggauguugcgcuagggcgccccaugugcgugggaacgacuccuuccgcuaaagccucuauccuccaugaaguccgaccagugaccucgggcuguuuucccauuaugcacgaccguacaaagaucagacaacugccuaaccuucugagggguuaugagaagauacgguugucaacucagaauguaaucgaugcagaaaaagccccagggggacccuaccgccucggcaccagcggcaguugcccuaacgcuacauccaagauuggguucuuugcaaccauggccugggcuguuccaaaagacaauuauaagaacgccacgaauccgcagacuguggagguccccuacaucuguacagaaggagaggaucagauuaccgugugggguuuccauucugacaacaaaacucaaaugaaaagccuguauggcgauuccaauccucagaaguuuacaucaagugcgaacggggugaccacgcacuacgucagccagaucggagacuucccagaucagaccgaggacggcggucugccccaaucugggagaauaguuguggauuauaugaugcagaagccuggaaagacaggcacuauuguauaccagaggggcgugcucuuaccacagaaagucuggugcgcauccgggcggucaaaggugaucaaaggaagccugccccuuauuggugaagccgacuguuugcaugaggaauacggcgggcugaauaagaguaaaccguauuacaccggaaagcacgcuaaggccaucggcaacugcccuaucuggguuaaaacaccccuaaagcucgcaaaugguacuaaauaucgcccuccagcuaagcugcuuaaagagcgaggguuuuucggcgccauugcgggauuucuggagggcgggugggaaggaaugauagccgguuggcacggcuacaccucucauggggcacacggaguggcugucgccgcugacuugaaguccacacaagaggccaucaacaagauuaccaaaaaccucaauagccugucggaauuagaggugaagaaccugcagagacucucuggcgcaauggaugaacuucauaaugagauccuggaguuggacgaaaaaguagaugaccuaagggccgauacuauauccucacagauugagcuggcuguucuccugaguaacgaagguaucaucaauagcgaggacgaacaccuucuggcguuggagcggaagcucaaaaagaugcuggggcccuccgcaguggauauuggcaacggauguuucgagacgaagcacaaaugcaaucaaacaugcuuagaccguaucgccgcuggcaccuuuaacgccggggaguucucucugccaacuuuugauagccuaaauauuaccgcagccucacucaacgacgauggacuggacaaucauacaauacuuuuguauuacaguaccgcugccuccagccuggcagucacucucaugcuggcgaucuucauuguguauauggucucucgcgacaacgugucauguaguaucugccuuuga

SEQ ID NO: 150533 - RNA, 1755 nt, Artificial Sequence; identical to SEQ ID NO: 150305
  derived and/or modified sequence opt3 from hemagglutinin__InfluenzaB__ALN39799

SEQ ID NO: 150534 - RNA, 1755 nt, Artificial Sequence
  derived and/or modified sequence opt3 from hemagglutinin__InfluenzaB__ALN39800
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagaagaaacucaagaagaugcuggggcccagcgcaguggauauuggcaauggauguuucgagacgaaacacaagugcaaccaaacaugcuuagaccggaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagucacucucaugcuggcgaucuucauuguguauauggucagccgugacaaugugucuuguucaaucugccuuuga

SEQ ID NO: 150535 - RNA, 1755 nt, Artificial Sequence; identical to SEQ ID NO: 150525
  derived and/or modified sequence opt3 from hemagglutinin__InfluenzaB__ALN39801

SEQ ID NO: 150536 - RNA, 1755 nt, Artificial Sequence; identical to SEQ ID NO: 150468
  derived and/or modified sequence opt3 from hemagglutinin__InfluenzaB__ALN39802

SEQ ID NO: 150537 - RNA, 1755 nt, Artificial Sequence; identical to SEQ ID NO: 150525
  derived and/or modified sequence opt3 from hemagglutinin__InfluenzaB__ALN39803

SEQ ID NO: 150538 - RNA, 1755 nt, Artificial Sequence; identical to SEQ ID NO: 150464
  derived and/or modified sequence opt3 from hemagglutinin__InfluenzaB__ALN39804

SEQ ID NO: 150539 - RNA, 1758 nt, Artificial Sequence; identical to SEQ ID NO: 150491
  derived and/or modified sequence opt3 from hemagglutinin__InfluenzaB__ALN39805

SEQ ID NO: 150540 - RNA, 1758 nt, Artificial Sequence; identical to SEQ ID NO: 149005
  derived and/or modified sequence opt3 from hemagglutinin__InfluenzaB__ACN29380

SEQ ID NO: 150541 - RNA, 1758 nt, Artificial Sequence; identical to SEQ ID NO: 149337
  derived and/or modified sequence opt3 from hemagglutinin__InfluenzaB__EPI498048

SEQ ID NO: 150542 - RNA, 1758 nt, Artificial Sequence
  derived and/or modified sequence opt3 from hemagglutinin__InfluenzaB__ANC28539
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaagcucagauggccaagcuguauggggauuccaagccucagaaauuuacuucuagcgcgaacggagugacaacccacuacgugucccaaaucggcgguuucccaaaccagacggaggacgggggacugccccagucaggccgcauugucguugauuauauggugcagaagaguggcaaaaccgggacaaucacuuaccaaagaggaauccucuuaccucagaagguauggugcgcaagcgguaggucuaaagugauuaagggcucccugccacuuauaggggaagccgacuguuugcaugagaaauauggaggccugaauaagucaaagcccuacuacaccggugagcacgcuaaagccaucgggaacugcccgauuugggucaagacaccucuaaaacucgcaaauggcacuaaguaucggcccccagcuaaacugcuuaaggaacgcggauuuuucggcgccaucgcgggguuucuggagggagguugggaaggcaugauagccggguggcauggauacaccagccacggcgcacacgguguggcuguugccgcugauuugaagaguacacaggaggccauuaacaaaaucaccaagaaucucaacucucuguccgaauuagaggugaaaaaucugcagcgacucagcggggcaauggacgagcuucauaacgaaauccuggaguuggaugaaaaggucgacgaccuaagagccgauacuauuucgucucaaaucgagcuggcugugcuccuguccaaugaaggcauuauaaacucagaggacgagcaccuucuggcguuggaaaggaaacucaagaagaugcugggaccuagugcaguagagaucggcaauggguguuucgaaacgaaacauaagugcaaccagacaugcuuagaucggauugccgcuggaaccuuugacgccggugaguucagccugcccacuuuugauucccuaaauaucaccgcagccucucucaacgacgauggccuggacaaucacacaauccuuuuguauuacagcaccgcugccucaagucuggcaguuacucucaugauugcgauauucguggucuauauggugucccgugauaacgucagcuguucuaucugccuguga

SEQ ID NO: 150543 - RNA, 1758 nt, Artificial Sequence
  derived and/or modified sequence opt3 from hemagglutinin__InfluenzaB__EPI827073
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggccugcacagugacaaugaaauccagauggcuaagcuguauggggauuccaagccucagaaauucacuucuagcgccaacggagugacaacccacuacgugucccaaauuggcgguuuuccaaaccagacggaggacgggggacucccccagucaggccgcaucgucguugauuauauggugcagaagaguggcaaaaccgggacaaucacuuaccaaagaggaauuuuacugccucagaagguauggugcgcgagcgguaggucuaaagugauaaagggcucccuuccauugaucggggaagcagacugucugcaugagaaauauggaggccuaaauaagucaaagcccuacuacaccggugagcacgccaaagcuauugggaacugcccgaucugggucaagacaccucucaaacuggccaauggcacuaaguaucggcccccagcaaaacuucugaaggaacgcggauucuuuggcgcuauagccggguucuuggagggagguugggaaggcaugauugcgggguggcauggauacaccagccacggcgcccacgguguggcaguugcugccgaucucaagaguacacaggaggcuaucaacaaaaucaccaagaaucugaacucuuuauccgaacuggaggugaaaaaucuccagcgacuuagcggggccauggacgagcugcauaacgaaauuuuggagcuagaugaaaaggucgacgaccugagagcagauacuaucucgucucaaauugagcucgccgugcugcuuuccaaugaaggcauaaucaacucagaggacgagcaccuguuggcucucgaaaggaaacugaagaagauguuaggaccuagugcgguagagauuggcaauggguguuuugaaacgaaacauaagugcaaccagacaugccuggaucggaucgcagccggaaccuucgacgcuggugaguuuagccuacccacuuucgauucccucaauaucaccgccgcaucucugaacgacgauggccuugacaaucacacaauuuugcuguauuacagcaccgccgcuucaagucucgccguuacucugaugauagcaaucuuuguggucuauauggugucccgugauaacgucagcuguucuauuugccuuuga

SEQ ID NO: 150544 - RNA, 1758 nt, Artificial Sequence; identical to SEQ ID NO: 148763
  derived and/or modified sequence opt3 from hemagglutinin__InfluenzaB__EPI244699

SEQ ID NO: 150545 - RNA, 1758 nt, Artificial Sequence; identical to SEQ ID NO: 148756
  derived and/or modified sequence opt3 from hemagglutinin__InfluenzaB__EPI244702

SEQ ID NO: 150546 - RNA, 1755 nt, Artificial Sequence; identical to SEQ ID NO: 150145
  derived and/or modified sequence opt3 from hemagglutinin__InfluenzaB__EPI540671

SEQ ID NO: 150547 - RNA, 1755 nt, Artificial Sequence
  derived and/or modified sequence opt3 from hemagglutinin__InfluenzaB__EPI573303
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacgauaaaacucagaugaagucucuguauggcgacagcaauccucaaaaguuuacauccucagcgaacggggugaccacgcacuacgucagucagaucggagauuucccagaccagaccgaggauggcggucucccccagagcgggagaauaguuguggacuauaugaugcaaaaaccuggaaagacaggcacuauuguauaccagaggggcguguuacugccacagaaagucuggugcgcaucugggcgguccaaggugaucaaaggaucacuucccuugauuggugaagccgacugucugcaugaggaauacggcgggcuaaauaagagcaaaccguauuacaccggaaagcacgcuaaggccaucggcaacugcccuaucuggguuaaaacaccccucaagcuggcaaaugguacuaaauaucgcccuccagcuaagcugcugaaagagcgaggguuuuucggcgccauugcgggauuuuuggagggcgggugggaaggaaugauagccgguuggcacggcuacaccagucauggggcacacggaguggcugucgccgcugaucucaagucuacacaggaggccaucaacaagauuaccaaaaaccuuaauuccuuaagcgaacuggaggugaagaaccuccaaagacuuucgggcgcaauggacgaacugcauaaugagaucuuggagcuagaugaaaaaguagacgaucugagggccgacacuauaucuucccagauugagcucgcuguucugcuuucaaacgaagguaucaucaauagugaggaugaacaccuguuggcgcucgagcggaagcugaaaaagauguuagggcccagcgcaguggacauuggcaacggauguuucgagacgaagcacaaaugcaaucagacaugccuggaucguaucgccgcuggcaccuuuaacgccggggaguucucccuaccaacuuuugacucucucaauauuaccgcagccagccugaacgaugacggacuugacaaucauacaauauugcuguauuacucaaccgcugccaguucccucgcagucacucugaugcuugcgaucuucauuguguauauggucagccgcgauaacgugucuuguucaaucugccuguga

SEQ ID NO: 150548 - RNA, 1755 nt, Artificial Sequence
  derived and/or modified sequence opt3 from hemagglutinin__InfluenzaB__EPI829466
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacgauaaaacucagaugaagucucuguauggcgacagcaauccucaaaaguuuacauccucagcgaacggggugaccacgcacuacgucagucagaucggagauuucccagaccagaccgaggaugaaggccucccccagagcgguagaauaguuguggacuauaugaugcaaaaaccugggaagacaggaacuauuguauaccagaggggcguguuacugccacagaaagucuggugcgcaucuggccgguccaaggugaucaaagggucacuucccuugauuggagaggccgacugucugcaugaagaguacgguggccuaaauaagagcaaaccguauuacaccgggaagcacgcuaaggccaucggaaacugcccuaucuggguuaaaacaccccucaagcuggcaaauggcacuaaauaucgcccuccagcuaagcugcugaaagagcgaggguuuuucggugccauugcgggcuuuuuggaaggaggcugggaggggaugauagccggauggcacgguuacaccagucauggcgcacacgggguggcugucgccgcugaucucaagucuacacaggaagccaucaacaagauuaccaaaaaccuuaauuccuuaagcgagcuggaagugaagaaccuccaaagacuuucgggagcaauggacgagcugcauaaugagaucuuggaacuagaugagaaaguagacgaucugagggccgacacuauaucuucccagauugaacucgcuguucugcuuucaaacgagggcaucaucaauagugaagaugagcaccuguuggcgcucgagcggaagcugaaaaagauguuaggucccagcgcaguggacauugggaacggcuguuucgaaacgaagcacaaaugcaaucagacaugccuggaucguaucgccgcuggaaccuuuaacgccggcgaguucucccuaccaacuuuugacucucucaauauuaccgcagccagccugaacgaugacgggcuugacaaucauacaauauugcuguauuacucaaccgcugccaguucccucgcagucacucugaugcuugcgaucuucauuguguauauggucagccgcgauaacgugucuuguucaaucugccuguga

SEQ ID NO: 150549 - RNA, 1755 nt, Artificial Sequence
  derived and/or modified sequence opt3 from hemagglutinin__InfluenzaB__EPI684429
augaaggccaucauugugcugcucauggucguuaugagcaacgcugacagaauaugcaccggcaucacauccucuaauucaccccacgugguaaaaacugcaacgcagggggaagugaacgucaccggagugauuccucuuacaacuaccccaacaaagaguuacuucgccaaucugaaagguaccaggacucggggcaaguuguguccggauugcuuaaacuguacagaccuggauguugcgcuagggcgccccaugugcgugggaaccacgccuagcgcuaaagccuccauccuccaugaaguccgaccagugacuucuggcuguuuucccauuaugcacgaccguaccaagaucagacaacugccuaaucuucugagggguuaugagaagauacgguugucgacacagaacguaaucgaugcagaaaaagccccagggggacccuaccgccucggcacuucaggcagcugcccuaaugcuaccaguaagauuggguucuuugcaacaauggccugggcuguuccaaaagacaacuauaagaaugccaccaacccgcagacgguggagguccccuacaucuguacugaaggagaggaucagauuacagugugggguuuccauuccgacaauaaaacccaaaugaagucucuguauggcgauagcaacccucagaaguuuacuuccucagcgaauggggugacaacccacuacgucagucagaucggagacuucccagaucagacggaggacggcggucugccccaaagcgggagaauaguuguggauuauaugguacagaaaccuggaaagaccggcacaauuguguaccagaggggcguccucuuaccacagaaaguguggugcguuucugggcgguccaaggugaucaaaggaucacugccccuuauuggugaagcagacuguuugcaugaggaauacggcgggcugaacaagagcaaaccguauuacacuggaaagcacgccaaggcuaucggcaauugcccuaucugggucaaaaccccucuaaagcucgccaacgguacaaaauaucgcccacccgcaaagcugcuuaaagagcgaggguuuuucggcgcuauugccggauuucuggagggcgggugggaaggaaugauagcggguuggcacggcuacacaagucauggggcccacggaguggcaguagcugccgacuugaagucuacccaagaggcuaucaacaagauuacuaaaaaucucaacucccugagcgaauuagagguuaagaaucugcagagacucucgggcgccauggaugaacuucauaacgagauccuggaguuggacgaaaaaguggaugaccuaagggcagauaccauaucuucccagauugagcuggccguccuccugucaaaugaagguaucaucaacagugaggacgaacaccuucuggcuuuggagcggaagcucaaaaagaugcuggggcccagcgcgguggauauuggcaauggauguuucgagacuaagcacaaaugcaaccaaacgugcuuagaccguaucgcagccggcacauuuaaugcuggggaguucucccugccaaccuuugauucucuaaacauuacugccgcaagccucaaugacgauggacuggacaaccauaccauacuuuuguauuacucaacagccgcuaguucccuggccgucacccucaugcuggcaaucuucauuguguauaugguuagccgcgacaaugugucuuguucaaucugccuuuga

SEQ ID NO: 150550 - RNA, 1758 nt, Artificial Sequence; identical to SEQ ID NO: 148768
  derived and/or modified sequence opt3 from hemagglutinin__InfluenzaB__AFH58447

SEQ ID NO: 150551 - RNA, 1758 nt, Artificial Sequence
  derived and/or modified sequence opt3 from hemagglutinin__InfluenzaB__EPI173279
augaaggccaucauugugauacugauggucguuaccagcaacgcugacagaaucugcacaggcauuacuuccucuaauucaccccacgugguaaaaacggcaacccagggggaggugaacgucacaggagugaucccucucacuaccacaccaaccaagagucauuucgccaaucuuaaagguacugaaacaaggggcaagcuguguccgaaaugcuugaacuguaccgauuuagacguugcgcuggggcggcccaagugcacgggaaagauuccuagcgcucgcguguccauccuacacgagguccgaccagugacuucuggcuguuuucccauaaugcaugaucguaccaaaaucagacaacucccuaaucugcuuagggguuacgaacacauucggcugucgacacauaacguaaucaaugccgagaacgcaccagggggacccuauaagauuggcacuucaggcagcugcccuaauaucaccaacgggaauggauucuuugccacaauggcuugggcaguuccaaagaacgacaagaauaaaaccgccacgaacccguugacuauagaagugcccuacauuuguacagagggugaggaucagaucaccgucuggggcuuccacagugacuccgaaacucagauggcuaagcucuauggggauucuaagccucagaaauuuacaagcuccgccaauggagugaccacgcacuacgugucacaaauuggcgguuucccaaaccagaccgaggacgggggacugccccagaguggccgcaucgucguugauuauauggugcagaaaagcggcaaaacagggacuaucaccuaccaaagagguauucugcucccucagaagguauggugcgcgucuggaagguccaaagugauaaagggcucauuaccacugaucggggaagcagacugucuucaugagaaauauggaggcuugaacaagagcaagcccuacuacacaggugagcacgccaaagcuauugggaauugcccgaucugggucaagacuccucugaaacuagccaacggcaccaaguaucggcccccagcaaaacuccugaaggaacgcggauuuuucggcgcuauagccggguuucuugagggagguugggaaggcaugauugcgggguggcauggauacacaagucacggcgcccacgguguggcaguugcugccgaucugaagucuacccaggaggcuaucaauaaaaucacuaagaaccuuaauucccucagcgaacuggaggugaaaaacuuacagcgacugucgggggccauggacgagcuccauaaugaaauucuugagcuggaugaaaaggucgacgacuugagagcagauacgaucucuucccaaauugagcuagccgugcugcucucaaacgaaggcauaaucaauagugaggacgagcaccuguuggcucuggaaaggaaauugaagaagaugcucggaccuagcgcgguagagauuggcaacggguguuucgaaacaaaacauaagugcaaucagaccugccuggaucggaucgcagccggaacuuuugacgcuggugaguucuccuuacccaccuuugauucucugaacaucacagccgcaagccuaaaugacgauggccucgacaaccacaccauucugcuuuauuacucaacugccgcuaguuccuuggccguuacacugaugauagcaaucuucguggucuauauggugagccgugauaaugucucuuguucaauuugccucuga

SEQ ID NO: 150552 - RNA, 1758 nt, Artificial Sequence; identical to SEQ ID NO: 149337
  derived and/or modified sequence opt3 from hemagglutinin__InfluenzaB__EPI163726

SEQ ID NO: 150553 - RNA, 1758 nt, Artificial Sequence; identical to SEQ ID NO: 150491
  derived and/or modified sequence opt3 from hemagglutinin__InfluenzaB__EPI636340

SEQ ID NO: 150554 - RNA, 1758 nt, Artificial Sequence
  derived and/or modified sequence opt3 from hemagglutinin__InfluenzaB__EPI645995
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacguacgguugucgacacauaacguuaucaaugccgaggacgcaccagggggacccuauaagauuggcacuucaggcagcugcccuaacaucaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugaugacgaaacucagauggcuaagcuguauggggauuccaagccucagaaauuuacaucuagcgccaacggagugaccacgcacuacgucucccaaauuggcgguuucccaaaucagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaacaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggacgaaaagguggaugaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgugauaacgugagcuguucuauaugccuguga

SEQ ID NO: 150555 - RNA, 1755 nt, Artificial Sequence; identical to SEQ ID NO: 150145
  derived and/or modified sequence opt3 from hemagglutinin__InfluenzaB__EPI539769

SEQ ID NO: 150556 - RNA, 1755 nt, Artificial Sequence; identical to SEQ ID NO: 150547
  derived and/or modified sequence opt3 from hemagglutinin__InfluenzaB__EPI551249

SEQ ID NO: 150557 - RNA, 1755 nt, Artificial Sequence
  derived and/or modified sequence opt3 from hemagglutinin__InfluenzaB__EPI544259
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaauaaaaaccagaugaagucucuguauggcgauagcaauccucaaaaguuuacuuccucagcgaacggggugacaacccacuacgucagucagaucggagacuucccagaucagacggaggacggcggucucccccagagcgggagaauaguuguggauuauaugaugcaaaaaccuggaaagaccggcacaauuguauaccagaggggcguguuacugccacagaaagucuggugcgcaucugggcgguccaaggugaucaaaggaucacuucccuugauuggugaagccgacugucugcaugaggaauacggcgggcuaaauaagagcaaaccguauuacacuggaaagcacgcuaaggccaucggcaacugcccuaucuggguuaaaaccccucucaagcuggcaaacgguacaaaauaucgcccacccgcuaagcugcugaaagagcgaggguuuuucggcgccauugcgggauuuuuggagggcgggugggaaggaaugauagccgguuggcacggcuacacaagucauggggcacacggaguggcugucgccgcugaccucaagucuacccaggaggccaucaauaagauuacuaaaaaccuuaauuccuuaagcgaacuggaggugaagaaccuccaaagacuuucgggcgcaauggaugaacugcauaaugagaucuuggagcuagacgaaaaaguagaugaccugagggccgauaccauaucuucccagauugagcucgcuguucugcuuucaaacgaagguaucaucaauagugaggacgaacaccuguuggcgcucgagcggaagcugaaaaagauguuagggcccagcgcaguggauauuggcaacggauguuucgagacuaagcacaaaugcaaucagacgugccuggaccguaucgccgcuggcacauuuaacgccggggaguucucccuaccaaccuuugauucucucaauauuacugcagccagccugaacgacgauggacuugacaaucauaccauauugcuguauuacucaacagcugccaguucccucgcagucacccugaugcuugcgaucuucauuguguauauggucagccgcgacaacgugucuuguucaaucugccuguga

SEQ ID NO: 150558 - RNA, 1755 nt, Artificial Sequence
  derived and/or modified sequence opt3 from hemagglutinin__InfluenzaB__EPI592699
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaauccaaaugaagucucuguauggcgauagcaacccucagaaguuuacuuccucagcgaauggggugacaacccacuacgucagucagauaggagacuucccagaucagacggaggacggcggucugccccaaagcgggagaauuguuguggauuauaugguacagaaaccuggaaagaccggcacaaucguguaccagaggggcguccucuuaccacagaaaguguggugcgcaucugggcgguccaagguuauuaaaggaucacugccccuuaucggugaagccgacuguuugcaugaggaauacggcgggcugaacaagagcaaaccguauuacacuggaaagcacgcuaaggccaucggcaauugcccuauuugggugaaaaccccucuaaagcucgcaaacgguacaaaauaucgcccacccgcuaagcugcuuaaagagcgaggguuuuucggcgccauagcgggauuucuggagggcgggugggaaggaaugaucgccgguuggcacggcuacacaagucauggggcacacggagucgcuguggccgcugacuugaagucuacccaagaggccauuaacaagaucacuaaaaaucucaacucccugagcgaauuagagguaaagaaucugcagagacucucgggcgcaauggaugaacuucauaacgagauacuggaguuggacgaaaaaguugaugaccuaagggccgauaccauuucuucccagaucgagcuggcugugcuccugucaaaugaagguaucauuaacagugaggacgaacaccuucuggcguuggagcggaagcucaaaaagaugcuggggcccagcgcagucgauaucggcaauggauguuucgagacuaagcacaaaugcaaccaaacgugcuuagaccguauugccgcuggcacauuuaaugccggggaguucucccugccaaccuuugauucucuaaacauaacugcagccagccucaaugacgauggacuggacaaccauaccauccuuuuguauuacucaacagcugccaguucccuggcagugacccucaugcuggcgauuuucaucgucuauauggugagccgcgacaauguuucuuguucaaucugccuuuga

SEQ ID NO: 150559 - RNA, 1755 nt, Artificial Sequence; identical to SEQ ID NO: 150468
  derived and/or modified sequence opt3 from hemagglutinin__InfluenzaB__EPI592707

SEQ ID NO: 150560 - RNA, 1755 nt, Artificial Sequence
  derived and/or modified sequence opt3 from hemagglutinin__InfluenzaB__EPI693094
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucagagagcugcccuaaugcuacaaguaagauuggcuucuuugcaaccauggccugggcuguuccaaaagacaacuauaagaaugccacgaacccgcagacuguggaaguccccuacaucuguacagagggggaggaucagauuaccguguggggauuccauuccgacaauaaaauccaaaugaagucucuguauggugauagcaacccucagaaguuuacuuccucagcgaauggcgugacaacccacuacgucagucagauaggggacuucccagaucagacggaagacggaggccugccccaaagcgguagaauuguuguggauuauaugguacagaaaccugggaagaccggaacaaucguguaccagaggggcguccucuuaccacagaaaguguggugcgcaucuggccgguccaagguuauuaaagggucacugccccuuaucggagaggccgacuguuugcaugaagaguacgguggccugaacaagagcaaaccguauuacacugggaagcacgcuaaggccaucggaaauugcccuauuugggugaaaaccccucuaaagcucgcaaacggcacaaaauaucgcccacccgcuaagcugcuuaaagagcgaggguuuuucggugccauagcgggcuuucuggaaggaggcugggaggggaugaucgccggauggcacgguuacacaagucauggcgcacacggggucgcuguggccgcugacuugaagucuacccaagaagccauuaacaagaucacuaaaaaucucaacucccugagcgaguuagaaguaaagaaucugcagagacucucgggagcaauggaugagcuucauaacgagauacuggaauuggacgagaaaguugaugaccuaagggccgauaccauuucuucccagaucgaacuggcugugcuccugucaaaugagggcaucauuaacagugaagacgagcaccuucuggcguuggagcggaagcucaaaaagaugcugggucccagcgcagucgauaucgggaauggcuguuucgaaacuaagcacaaaugcaaccaaacgugcuuagaccguauugccgcuggaacauuuaaugccggcgaguucucccugccaaccuuugauucucuaaacauaacugcagccagccucaaugacgaugggcuggacaaccauaccauccuuuuguauuacucaacagcugccaguucccuggcagugacccucaugcuggcgauuuucaucgucuauauggugagccgcgacaauguuucuuguucaaucugccuuuga

SEQ ID NO: 150561 - RNA, 1758 nt, Artificial Sequence; identical to SEQ ID NO: 150491
  derived and/or modified sequence opt3 from hemagglutinin__InfluenzaB__EPI678796

SEQ ID NO: 150562 - RNA, 1758 nt, Artificial Sequence
  derived and/or modified sequence opt3 from hemagglutinin__InfluenzaB__EPI721064
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacguacgguugucgacacauaacguuaucaaugccgaggacgcaccagggggacccuauaagauuggcacuucacgcagcugcccuaacaucaccaauggcaacggguucuuugccacaauggcuugggcagugcccaaaaaugauaagaacaaaaccgccacgaauccgcucacuauugaaguccccuacaucuguacagagggagaggaccagauaaccgugugggguuuccacagugauaacgaaacucagauggcuaagcuguauggcgacuccaagccucagaaauuuacaucuagcgccaauggggugaccacgcacuacgucucccaaauuggaggcuucccaaaccagaccgaggauggugggcugccccagucaggaagaaucguuguggacuauaugguacagaagaguggcaaaacaggcacuauuaccuaccaaagggggauccucuuaccucagaagguguggugcgcgagcggacggucuaaagucaucaaggguucccugccacuuauuggcgaagcagauuguuugcaugagaaauaugggggacugaacaagucaaagcccuacuacacaggcgagcacgccaaagcuauagguaauugcccgaucugggugaagacuccucuaaaacucgccaacgggaccaaguaucgcccaccagcaaaacugcuuaaggaacgaggcuuuuucggagcuauugccggcuuucuggaagggggaugggaggguaugaucgcgggcuggcauggguacacaagccacggagcccacggcguugcaguggcugccgacuugaagaguacccaggaggcuauaaauaaaauuacuaagaaccucaauucucuguccgaauuagaggucaaaaaccugcagagacucagcggugccauggaugagcuucauaaugaaauccuggaguuggacgaaaagguggacgaucuaagggcagacacgaucucgucucaaauugagcuggccguacuccuguccaacgaagggaucauuaauucagaggaugagcaccuucuggcuuuggaacggaaacucaagaagaugcugggcccuagugcgguugagauaggaaacggcuguuucgaaacaaaacauaagugcaaucagaccugcuuagaccguaucgcagccgggacuuuugaugcuggagaguucagccugcccaccuuugacucccuaaacauuacagccgcaucucucaaugaugacggucuggauaaccacaccauccuuuuguauuacagcacugccgcuucaagucuggccgugacacucaugaucgcaauuuucgucguguauauggucucccgcgacaaugugagcuguucuauaugccuguga

SEQ ID NO: 150563 - RNA, 1758 nt, Artificial Sequence; identical to SEQ ID NO: 148772
  derived and/or modified sequence opt3 from hemagglutinin__InfluenzaB__EPI328904

SEQ ID NO: 150564 - RNA, 1755 nt, Artificial Sequence
  derived and/or modified sequence opt3 from hemagglutinin__InfluenzaB__EPI543191
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaaaaagacucagaugaagucucuguauggcgauagcaauccucaaaaauuuacauccucagcgaacggggugaccacgcacuacgucagucagaucggagacuucccagaucagaccgaggacggcggucucccccagagcgggagaauaguuguggauuauaugaugcaaaagccuggaaaaacaggcacuauuguauaccagaggggcguguuacugccacagaaggucuggugcgcaucugggcgguccaaagugaucaagggaucacuucccuugauuggugaagccgacugucugcaugaggaauacggcgggcuaaauaaaagcaagccguauuacaccggaaagcacgcuaaagccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaccucaagucuacacaggaggccaucaacaaaauuaccaagaacuuaaauucccugagcgaacuggaggugaaaaaccuccaaagacuuucgggcgcaauggaugaacugcauaaugagaucuuggagcuagacgaaaagguagaugaccugagggccgauacuauaucuucccagauugagcucgcuguucugcuuucaaacgaagguaucaucaauagugaggacgaacaccuguuggcgcucgagcggaaacugaagaagauguuagggcccagcgcaguggauauuggcaacggauguuucgagacgaaacacaagugcaaucagacaugccuggaccguaucgccgcuggcaccuuuaacgccggggaguucucccuaccaacuuuugauucucucaauauuaccgcagccagccugaacgacgauggacuugacaaucauacaauauugcuguauuacucaaccgcugccaguucccucgcagucacucugaugcuugcgaucuucauuguguauauggucagccgcgacaacgugucuuguucaaucugccuguga

SEQ ID NO: 150565 - RNA, 1755 nt, Artificial Sequence; identical to SEQ ID NO: 150145
  derived and/or modified sequence opt3 from hemagglutinin__InfluenzaB__EPI500359

SEQ ID NO: 150566 - RNA, 1755 nt, Artificial Sequence
  derived and/or modified sequence opt3 from hemagglutinin__InfluenzaB__EPI543185
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaaaccaaaugaagucucuguauggcgauagcaauccucagaaguuuacuuccucagcgaacggggugacaacccacuacgucagucagaucggagacuucccagaucagacggaggacggcggucugccccaaagcgggagaauaguuguggauuauaugaugcagaaaccuggaaagaccggcacaauuguauaccagaggggcgugcucuuaccacagaaagucuggugcgcaucugggcgguccaaggugaucaaaggaucacugccccuuauuggugaagccgacuguuugcaugaggaauacggcgggcugaauaagagcaaaccguauuacacuggaaagcacgcuaaggccaucggcaacugcccuaucuggguuaaaaccccucuaaagcucgcaaacgguacaaaauaucgcccacccgcuaagcugcuuaaagagcgaggguuuuucggcgccauugcgggauuucuggagggcgggugggaaggaaugauagccgguuggcacggcuacacaagucauggggcacacggaguggcugucgccgcugacuugaagucuacccaagaggccaucaauaagauuacuaaaaaccucaauucccugagcgaauuagaggugaagaaccugcagagacucucgggcgcaauggaugaacuucauaaugagauccuggaguuggacgaaaaaguagaugaccuaagggccgauaccauaucuucccagauugagcuggcuguucuccugucaaacgaagguaucaucaauagugaggacgaacaccuucuggcguuggagcggaagcucaaaaagaugcuggggcccagcgcaguggauauuggcaacggauguuucgagacuaagcacaaaugcaaucaaacgugcuuagaccguaucgccgcuggcacauuuaacgccggggaguucucccugccaaccuuugauucucuaaauauuacugcagccagccucaacgacgauggacuggacaaucauaccauacuuuuguauuacucaacagcugccaguucccuggcagucacccucaugcuggcgaucuucauuguguauauggucagccgcgacaacgugucuuguucaaucugccuuuga

SEQ ID NO: 150567 - RNA, 1755 nt, Artificial Sequence; identical to SEQ ID NO: 150305
  derived and/or modified sequence opt3 from hemagglutinin__InfluenzaB__EPI536447

SEQ ID NO: 150568 - RNA, 1755 nt, Artificial Sequence; identical to SEQ ID NO: 148774
  derived and/or modified sequence opt3 from hemagglutinin__InfluenzaB__NP_056660

SEQ ID NO: 150569 - RNA, 1755 nt, Artificial Sequence
  derived and/or modified sequence opt3 from hemagglutinin__InfluenzaB__ABG85167
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaggagucauuucgccaaucugaaggguacucaaacacggggcaaauuguguccgaacugcuuuaauuguaccgauuuagacguugcgcuggggcgccccaagugcaugggaaacaucccuagcgcuaaaguguccauucuacacgaagucaagccagugacgucuggcuguuuccccaucaugcaugaucgaacuaagauacgucagcucccuaaucugcuuagagguuacgagaacaucaggcugucgaccucaaauguaauuaacgccgaaacagcaccagggggacccuauaaaguuggcacuagcggcaguugcccuaauguggccaaccggaauggguuuuucaacaccauggcuugggucaucccaaaggacaauaacaaaacagcaauuaacccggugaccguggagguccccuacaucuguuccgaaggagaggaucagauaacgguuugggguuuucacucugacgauaagacucagauggagcgcuuguauggcgacagcaauccucaaaaauucacauccucagccaacggggugaccacucauuacguaagucagauuggaggcuuuccaaaucagacagaagaugagggucucaagcagagcgggagaaucguggucgacuauauggugcaaaagcccggaaaaaccggcacgauuguuuaccagaggggcauccugcugccucagaagguguggugcgcuucugggcgguccaaagucaucaagggaucacucccauuaauuggugaagccgauugucugcacgagaaauauggcgggcuuaacaagagcaaacccuacuacaccggagagcacgcgaaggcaauaggcaauugcccgaucugggugaagacaccuuugaaacuggccaacgguacuaaguaucgacccccagcuaaacuacucaaggaacgcggguucuuuggcgccauugcaggauuccuggagggcgggugggaaggaaugaucgcugguuggcauggcuacaccagucacggggcccauggaguagcgguugccgcagaccuuaaaucuacacaggaggcuauaaauaagauuacuaagaaccugaacuccuugagcgaacucgaggugaaaaaucugcaaagauuaucgggcgccaugaauggucugcacgaugagauccucgaacuugacgagaaggucgacgaucugagggcugacaccaucucuucccagauugaauuggccgugcuacugucaaacgaggggaucauuaauagugaagaugagcaccuccuggcacuugagcggaaacugaagaaaauguugggcccuagcgccgucgaaauaggaaacggcuguuuugagacaaagcauaagugcaaucagaccugccucgaccguaucgcugcggggacuuucaacgcaggagauuuuucccugcccacguucgacucuuuaaacauuacagccgcuagccugaaugaugacgaucuagacaaccacaccauccuccuguauuacucaacugccgcaaguucccuugccgugaccuugaugaucgcuauuuucauaguuuauauggugagccgcgauaauguaucuuguucaaucugccuguga

SEQ ID NO: 150570 - RNA, 1755 nt, Artificial Sequence
  derived and/or modified sequence opt3 from hemagglutinin__InfluenzaB__EPI376346
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacgauaaaacccagaugaagaaucuguacggcgacagcaacccccaaaaguuuacuuccucagccaauggggugacaacccacuaugucagucagauuggaggcuucccugaucagacggaggacggugggcucccacagagcggacgcaucguuguggauuacaugaugcaaaaacccggcaagaccggcacaauaguauaucagagagggguguuacugccucagaaagucuggugcgcuucuggaagguccaaggugauuaaagguucacuuccauugaucggcgaagccgacugucugcaugagaaguacgggggacuaaacaaaagcaagcccuacuauacuggcgaacacgcaaaggcuauugguaacugcccgaucuggguuaaaaccccucucaagcuggccaaugggacaaaauaccggcccccagcgaaacuucugaaggagcgcggcuuuuucggagccaucgcaggcuuuuuggaagggggaugggaagguaugauugcuggcuggcacggguauacaagucauggagcccacggcguggcugucgccgcagaccucaagucuacccaggaggccauaaacaagaucacuaaaaaucugaacuccuuaagcgaacuggaggugaagaaucuccaacgacuuucgggugcuauggaugaacugcauaacgagauuuuggagcuagacgaaaaaguagaugaccugagagcggauaccaucucuucccagauagagcucgcaguucugcuuucaaaugaagggauuaucaacagugaggacgaacaccuguuggcccucgagaggaagcugaaaaagauguuaggcccuagcgcuguggauaucggaaauggcuguuucgagacuaagcacaaaugcaaccagacgugccuggaccggauugccgcagggacauuuaaugccggagaguucucccuacccaccuuugauucucucaacaucacugcugccagccugaaugacgauggucuugacaaccauaccauuuugcuguacuauucaacagcagcgaguucccucgcugucacccugaugcuugccauauucaucguguacauggucagccgugacaaugugucuuguucaauuugccuguga

SEQ ID NO: 150571 - RNA, 1755 nt, Artificial Sequence; identical to SEQ ID NO: 148870
  derived and/or modified sequence opt3 from hemagglutinin__InfluenzaB__EPI368425

SEQ ID NO: 150572 - RNA, 1755 nt, Artificial Sequence; identical to SEQ ID NO: 148836
  derived and/or modified sequence opt3 from hemagglutinin__InfluenzaB__ACH53430

SEQ ID NO: 150573 - RNA, 1758 nt, Artificial Sequence; identical to SEQ ID NO: 148661
  derived and/or modified sequence opt3 from hemagglutinin__InfluenzaB__EPI331151

SEQ ID NO: 150574 - RNA, 1758 nt, Artificial Sequence
  derived and/or modified sequence opt3 from hemagglutinin__InfluenzaB__EPI356777
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacgaugaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgacuugaagaguacccaggaggcuauaaauaaaauuacuaagaaccucaauucucuguccgaauuagaggucaaaaaccugcagcgacucagcggggccauggaugagcuucauaaugaaauccuggaguuggacgaaaagguggacgaucuaagagcagacacgaucucgucucaaauugagcuggccguacuccuguccaacgaaggcaucauuaauucagaggaugagcaccuucuggcuuuggaaaggaaacucaagaagaugcugggaccuagugcgguugagauaggcaacggguguuucgaaacaaaacauaagugcaaucagaccugcuuagaccggaucgcagccggaacuuuugaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgugacaaugugagcuguucuauaugccuguga

SEQ ID NO: 150575 - RNA, 1752 nt, Artificial Sequence; identical to SEQ ID NO: 148443
  derived and/or modified sequence opt3 from hemagglutinin__InfluenzaB__CY018349

SEQ ID NO: 150576 - RNA, 1752 nt, Artificial Sequence
  derived and/or modified sequence opt3 from hemagglutinin__InfluenzaB__AY581945
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagcucggcccaugugcguggggacgacuccuagcgccaaggcauccauccuccacgaaguccgcccagugaccucuggauguuuucccauuaugcaugaucgaacaaagauccgucaacugccuaaccuucugagaggcuacgagaauauaagguugucgacucagaacguaaucaaugccgaacgggcuccaggugggcccuaucgccucggaaccucaggcagcugcccuaacguuacaaguagagacggcuucuuugcaaccauggccugggcugugccaagggauaauaaaacggccacuaacccgcugacagucgaggugcccuacauuuguaccaagggggaagaccagaucacuguguggggauuccacuccgauaauaaaacacagaugaagaaccuguauggugacucuaauccucaaaaauuuaccagcuccgcgaacggcgucacgacccauuacguuucacagauugggggauucccaaaccagacagaggauggcggucucccccagagugggcggaucgugguagacuauauggugcaaaagccuggaaagacuggcaccauagucuaccagcgcggcguguuacugccacagaaaguuuggugcgcaagcgggcgaucuaaggugauuaaaggaucccuucccuugaucggugaggccgauugucugcacgaaaaguauggcgggcuaaauaaaucaaagccguacuacacaggagagcacgcuaaagccauuggcaacugcccuaucugggucaagacuccccucaagcuggcaaaugguaccaaauauagaccuccagcuaaacuucugaaggaaaggggguuuuucggcgccaucgcgggauuuuuggagggcgggugggagggaaugauugccgguuggcauggcuacacaagccacggggcacauggaguggcuguagccgcugaccucaagaguacccaggaagccauaaacaaaaucacuaagaaucugaacucuuuauccgagcuggaaguuaagaaucuccaacggcuuagcggcgcaauggaugagcugcacaacgaaauuuuggagcuagacgagaaaguggacgaucugcgugccgacacgaucucgucucagauagaacucgcuguccugcuuuccaaugaggguauuaucaacucagaagaugagcaccuguuggcgcucgaacgcaagcugaaaaagauguuagggcccagugcaguggacaucggcaauggauguuucgagacaaaacauaagugcaaccagaccugccuggauagaauugccgcuggcacuuuuaaugccggggaguucagccuaccaaccuuugacucccucaacaucacagcagccucucugaaugaugacggacuugauaaccacaccauuuugcuguauuacagcacugcugccucaagucucgcagucacacugaugauagcgaucuucauuguguauaugguuuccagggacaacgugagcuguucuaucugccuuuga

SEQ ID NO: 150577 - RNA, 1755 nt, Artificial Sequence; identical to SEQ ID NO: 150324
  derived and/or modified sequence opt3 from hemagglutinin__InfluenzaB__EPI541351

SEQ ID NO: 150578 - RNA, 1755 nt, Artificial Sequence
  derived and/or modified sequence opt3 from hemagglutinin__InfluenzaB__EPI541760
augaaggccgugaucguccugcucaugguugugaccagcaacgcugacagaauuugcacaggcauaacuuccucuaauucaccccacguagugaaaacggcaacccagggggaagucaacgugacaggaguuaucccucuuacuaccacaccaaccaagaguuacuucgccaaucugaaagguacuaggacacggggcaaguuguguccggauugcuuaaacuguaccgaccuggauguggcgcuagggcgccccaugugcgucggaacgacuccuagcgcuaaagccuccauucuccaugaagugcgaccaguaaccucuggcuguuuucccaucaugcacgaccguacaaagauuagacaacugccuaaucuucugagggguuaugagaagauccgguugucgacucagaacguuauagaugcagaaaaagccccagggggacccuaccgccucggcaccucaggcagcugcccuaaugcuacaaguaagaucggguucuuugcaaccauggccugggcugugccaaaagacaacuauaagaaugccacgaacccgcugacugucgaggugcccuacauuuguacagaaggagaggaucagaucaccgugugggguuuccauuccgacaauaaaacucagaugaagucucuguauggcgauagcaacccucaaaaguuuacauccucagcgaauggggucaccacgcacuacguuagucagauuggagacuucccagaucagaccgaggacggcggucucccccagagcgggagaaucgugguagauuauaugaugcaaaaaccuggaaagacaggcacuauaguguaccagaggggcgucuuacugccacagaaaguguggugcgcaucugggcgguccaagguuauuaaaggaucacuucccuugaucggugaagccgacugucugcaugaggaauacggcgggcuaaacaagagcaaaccguauuacaccggaaagcacgcuaaggccauuggcaauugcccuaucugggugaaaacaccccucaagcuggcaaacgguacuaaauaucgcccuccagcuaaacuucugaaggagcgaggguuuuucggcgccaucgcgggauuuuuggagggcgggugggaaggaaugauugccgguuggcacggcuacaccagucauggggcacacggagucgcuguggccgcugaccucaagucuacacaggaggccauaaacaagaucaccaaaaaucugaacuccuuaagcgaacuggagguaaagaaucuccaaagacuuucgggcgcaauggaugaacugcauaacgagauuuuggagcuagacgaaaaaguugaugaccugagggccgauacuaucucuucccagauagagcucgcugugcugcuuucaaaugaagguauuaucaacagugaggacgaacaccuguuggcgcucgagcggaagcugaaaaagauguuagggcccagcgcagucgauaucggcaauggauguuucgagacgaagcacaaaugcaaccagacaugccuggaccguauugccgcuggcaccuuuaaugccggggaguucucccuaccaacuuuugauucucucaacaucaccgcagccagccugaaugacgauggacuugacaaccauacaauuuugcuguauuacucaaccgcugccaguucccucgcagugacucugaugcuugcgauauucaucgucuauauggugagccgcgacaauguuucuuguucaauuugccuguga

SEQ ID NO: 150579 - RNA, 1758 nt, Artificial Sequence; identical to SEQ ID NO: 148903
  derived and/or modified sequence opt3 from hemagglutinin__InfluenzaB__EPI477397

SEQ ID NO: 150580 - RNA, 1758 nt, Artificial Sequence
  derived and/or modified sequence opt3 from hemagglutinin__InfluenzaB__EPI492571
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauauugaaacucagauggcuaagcuguauggggacuccaagccucagaaauuuacaucuagcgccaacggagugaccacgcacuacgucucccaaaucggcgguuucccaaaucagaccgaggaugggggacugccccagucaggccgcauuguuguggacuauaugguacagaagaguggcaaaacagggacuaucaccuaccaaagaggaauccucuuaccucagaagguguggugcgcgagcgguaggucuaaagucauuaagggcucccugccacuuauaggggaagcagauuguuugcaugagaaauauggaggccugaacaagucaaagcccuacuacacaggugagcacgccaaagcuaucgggaacugcccgauuugggugaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguugcaguggcugccgacuugaagaguacccaggaggcuauuaacaaaaucacuaagaaucucaacucucuguccgaauuagaggucaaaaaucugcagcgacucagcggggccauggaugagcuucauaacgaaauccuggaguuggacgaaaagguggacgaucuaagagcagacacgauuucgucucaaaucgagcuggccguacuccuguccaaugaaggcauuauaaacucagaggaugagcaccuucuggcuuuggaaaggaaacucaagaagaugcugggaccuagugcgguugagaucggcaauggguguuucgaaacaaaacauaagugcaaccagaccugcuuagaccggauugcagccggaacuuuugaugcuggugaguucagccugcccaccuuugacucccuaaauaucacagccgcaucucucaacgaugacggccuggauaaucacaccauccuuuuguauuacagcacugccgcuucaagucuggccgugacacucaugauugcaauauucgucguguauauggucucccgugacaacgugagcuguucuaucugccuguga

SEQ ID NO: 150581 - RNA, 1758 nt, Artificial Sequence
  derived and/or modified sequence opt3 from hemagglutinin__InfluenzaB__EPI498340
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaauacugaggacgccccagggggacccuauaagaucggcaccucaggcagcugcccuaacguuacaaaugggaacggauucuuugcaaccauggccugggcugugccgaaaaaugauaagaacaaaacggcaacuaauccacucacaauugaaguccccuacaucuguaccgagggugaggaccagauaacuguguggggcuuccacagugauauugaaacacagauggccaagcuguauggggacuccaagccucagaaauuuaccucuagcgcuaacggagugacgacccacuacgucucccaaaucggcgguuucccaaaucagacagaggaugggggacugccccagucaggccgcauuguuguggacuauaugguacagaagaguggcaaaacugggaccaucacauaccaaagaggaauccucuuaccucagaagguguggugcgccagcgguaggucuaaagucauuaagggcucccugccacuuauaggggaagcggauuguuugcaugagaaauauggaggccugaacaagucaaagcccuacuacacuggugagcacgcaaaagccaucgggaacugcccgauuugggugaagaccccucuaaaacucgcuaauggcacaaaguaucggcccccagccaaacugcuuaaggaacgcggauuuuucggcgcaaucgcuggguuucuggagggagguugggaaggcaugauagccggguggcauggauacaccagccacggcgcgcacgguguugccguggcagcugacuugaagaguacucaggaggccauuaacaaaaucacgaagaaucucaacucucuguccgaauuagaggucaaaaaucugcagcgacucagcggggcuauggaugagcuucauaacgaaauccuggaguuggacgaaaagguggacgaucuaagagccgacacaauuucgucucaaaucgagcuggcaguacuccuguccaaugaaggcauuauaaacucagaggaugagcaccuucuggccuuggaaaggaaacucaagaagaugcugggaccuagugcuguugagaucggcaauggguguuucgaaaccaaacauaagugcaaccagacuugcuuagaccggauugcggcaggaaccuuugaugccggugaguucagccugcccacauuugacucccuaaauaucaccgcugccucucucaacgaugacggccuggauaaucacacuauccuuuuguauuacagcacagcagccucaagucuggcugugacgcucaugauugccauauucgucguguauauggucucccgugacaacgugagcuguucuaucugccuguga

SEQ ID NO: 150582 - RNA, 1758 nt, Artificial Sequence
  derived and/or modified sequence opt3 from hemagglutinin__InfluenzaB__EPI516490
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaauucagauggcuaagcuguauggggacuccaagccucagaaauuuacuucuagcgccaauggagugacaacccacuacgucucccaaaucggcgguuucccaaaccagacggaggaugggggacugccccagucaggccgcauuguuguggacuauaugguacagaagaguggcaaaaccgggacaaucacuuaccaaagaggaauccucuuaccucagaagguguggugcgcgagcgguaggucuaaagucauuaagggcucccugccacuuauaggggaagcagauuguuugcaugagaaauauggaggccugaacaagucaaagcccuacuacaccggugagcacgccaaagcuaucgggaauugcccgauuugggugaagacaccucuaaaacucgccaacggcacuaaguaucggcccccagcaaaacugcuuaaggaacgcggauuuuucggcgcuaucgccggguuucuggagggagguugggaaggcaugauagcgggguggcauggauacaccagccacggcgcccacgguguugcaguggcugccgacuugaagaguacacaggaggcuauuaauaaaaucaccaagaaccucaauucucuguccgaauuagaggucaaaaaccugcagcgacucagcggggccauggaugagcuucauaaugaaauccuggaguuggacgaaaagguggacgaucuaagagcagacacuauuucgucucaaaucgagcuggccguacuccuguccaacgaaggcauuauaaauucagaggaugagcaccuucuggcuuuggaaaggaaacucaagaagaugcugggaccuagugcgguugagaucggcaacggguguuucgaaacgaaacauaagugcaaucagacaugcuuagaccggauugcagccggaaccuuugaugcuggugaguucagccugcccacuuuugacucccuaaacaucaccgccgcaucucucaaugaugacggccuggauaaccacacaauccuuuuguauuacagcaccgccgcuucaagucuggccgugacucucaugauugcaauauucgucguguauauggucucccgugacaaugugagcuguucuaucugccuguga

SEQ ID NO: 150583 - RNA, 1755 nt, Artificial Sequence; identical to SEQ ID NO: 150145
  derived and/or modified sequence opt3 from hemagglutinin__InfluenzaB__EPI538119

SEQ ID NO: 150584 - RNA, 1755 nt, Artificial Sequence; identical to SEQ ID NO: 150564
  derived and/or modified sequence opt3 from hemagglutinin__InfluenzaB__EPI538125

SEQ ID NO: 150585 - RNA, 1755 nt, Artificial Sequence
  derived and/or modified sequence opt3 from hemagglutinin__InfluenzaB__EPI556422
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaucaaaacucagaugaagucucuguauggcgauagcaauccucaaaaguuuacauccucagcgaacggggugaccacgcacuacgucagucagauaggagacuucccagaucagaccgaggacggcggucucccccagagcgggagaauuguuguggauuauaugaugcaaaaaccuggaaagacaggcacuaucguauaccagaggggcguguuacugccacagaaagucuggugcgcaucugggcgguccaaggugauuaaaggaucacuucccuugaucggugaagccgacugucugcaugaggaauacggcgggcuaaauaagagcaaaccguauuacaccggaaagcacgcuaaggccaucggcaacugcccuauuuggguuaaaacaccccucaagcuggcaaaugguacuaaauaucgcccuccagcuaagcugcugaaagagcgaggguuuuucggcgccauagcgggauuuuuggagggcgggugggaaggaaugaucgccgguuggcacggcuacaccagucauggggcacacggaguggcugucgccgcugaccucaagucuacacaggaggccauuaacaagaucaccaaaaaccuuaauuccuuaagcgaacuggaggugaagaaccuccaaagacuuucgggcgcaauggaugaacugcauaaugagauauuggagcuagacgaaaaaguagaugaccugagggccgauacuauuucuucccagaucgagcucgcuguucugcuuucaaacgaagguaucauuaauagugaggacgaacaccuguuggcgcucgagcggaagcugaaaaagauguuagggcccagcgcaguggauaucggcaacggauguuucgagacgaagcacaaaugcaaucagacaugccuggaccguauugccgcuggcaccuuuaacgccggggaguucucccuaccaacuuuugauucucucaauauaaccgcagccagccugaacgacgauggacuugacaaucauacaaucuugcuguauuacucaaccgcugccaguucccucgcagucacucugaugcuugcgauuuucaucguguauauggucagccgcgacaacgugucuuguucaaucugccuguga

SEQ ID NO: 150586 - RNA, 1755 nt, Artificial Sequence
  derived and/or modified sequence opt3 from hemagglutinin__InfluenzaB__EPI614608
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccaauuaccucuggcuguuuucccaucaugcacgaccguacaaagauaagacaacugccuaaucuucugagggguuaugagaagauccgguugucgacucagaacgugauugaugcagaaaaagccccagggggacccuaccgccucggcaccucaggcagcugcccuaaugcuacaaguaagaucggguucuuugcaaccauggccugggcuguaccaaaagacaacuauaagaaugccacgaacccgcugacuguugaggugcccuacauuuguacagaaggagaggaucagaucaccgucugggguuuccauuccgacgagaaaacucagaugaagucucuguauggcgauagcaauccucaaaaguuuacauccucagcgaacggggugaccacgcacuacgugagucagauaggagacuucccagaucagaccgaagacggcggucucccccagagcgggagaauugucguugauuauaugaugcaaaaaccuggaaagacaggcacuaucguguaccagaggggcguauuacugccacagaaaguguggugcgcaucugggcgguccaaggucauuaaaggaucacuucccuugaucggugaggccgacugucugcaugaagaguacggcgggcuaaauaagagcaaaccguauuacaccggaaagcacgcuaaggccaucggcaacugcccuauuugggugaaaacaccccucaagcuggcaaaugguacuaaauaucgcccuccagcuaagcugcugaaagagcgaggguuuuucggcgccauagcgggauuuuuggaaggcgggugggagggaaugaucgccgguuggcacggcuacaccagucauggggcacacggaguugcuguggccgcugaccucaagucuacacaggaagccauuaacaagaucaccaaaaaccuuaauuccuuaagcgagcuggaagucaagaaccuccaaagacuuucgggcgcaauggaugagcugcauaaugagauauuggaacuagacgagaaaguggaugaccugagggccgauacuauuucuucccagaucgaacucgcuguacugcuuucaaacgaggguaucauuaauagugaagacgagcaccuguuggcgcucgagcggaagcugaaaaagauguuagggcccagcgcaguugauaucggcaacggauguuucgaaacgaagcacaaaugcaaucagacaugccuggaccguauugccgcuggcaccuuuaacgccggggaguucucccuaccaacuuuugauucucucaauauaaccgcagccagccugaacgacgauggacuugacaaucauacaaucuugcuguauuacucaaccgcugccaguucccucgcagugacucugaugcuugcgauuuucaucgucuauauggugagccgcgacaacgucucuuguucaaucugccuguga

SEQ ID NO: 150587 - RNA, 1755 nt, Artificial Sequence
  derived and/or modified sequence opt3 from hemagglutinin__InfluenzaB__EPI614610
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacgagaaaacucagaugaagucucuguauggcgauagcaauccucaaaaguuuacauccucagcgaacggggugaccacgcacuacgucagucagaucggagacuucccagaucagaccgaagacggcggucucccccagagcgggagaauaguuguggauuauaugaugcaaaaaccuggaaagacaggcacuauuguauaccagaggggcguguuacugccacagaaagucuggugcgcaucugggcgguccaaggugaucaaaggaucacuucccuugauuggugaggccgacugucugcaugaagaguacggcgggcuaaauaagagcaaaccguauuacaccggaaagcacgcuaaggccaucggcaacugcccuaucuggguuaaaacaccccucaagcuggcaaaugguacuaaauaucgcccuccagcuaagcugcugaaagagcgaggguuuuucggcgccauugcgggauuuuuggaaggcgggugggagggaaugauagccgguuggcacggcuacaccagucauggggcacacggaguggcugucgccgcugaccucaagucuacacaggaagccaucaacaagauuaccaaaaaccuuaauuccuuaagcgagcuggaagugaagaaccuccaaagacuuucgggcgcaauggaugagcugcauaaugagaucuuggaacuagacgagaaaguagaugaccugagggccgauacuauaucuucccagauugaacucgcuguucugcuuucaaacgaggguaucaucaauagugaagacgagcaccuguuggcgcucgagcggaagcugaaaaagauguuagggcccagcgcaguggauauuggcaacggauguuucgaaacgaagcacaaaugcaaucagacaugccuggaccguaucgccgcuggcaccuuuaacgccggggaguucucccuaccaacuuuugauucucucaauauuaccgcagccagccugaacgacgauggacuugacaaucauacaauauugcuguauuacucaaccgcugccaguucccucgcagucacucugaugcuugcgaucuucauuguguauauggucagccgcgacaacgugucuuguucaaucugccuguga

SEQ ID NO: 150588 - RNA, 1758 nt, Artificial Sequence
  derived and/or modified sequence opt3 from hemagglutinin__InfluenzaB__AAA43697
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagcucggcccaagugcauggggacgaucccuagcgccaaagcauccauucuccacgaagugaagccagucacuucuggauguuuucccaucaugcaugaucgcaccaaaauacgacaacugccuaaucuucugcguggcuacgagcacaucagauugucgacacauaacgugauuaaugccgaaacugcuccaggugggcccuauaagguaggaaccucaggcagcugcccuaacguuacaaauggcaacggguucuuugcaaccauggccugggcugugccgaaaaaugacaacaauaagacggccacuaacccacucacagucgaggugcccuacaucuguaccgaaggagaggaucagauuacugugugggguuuccacagugacuccgagacacagauggucaagcuguauggcgauucuaaaccucagaaguuuaccagcuccgcgaaugggguuacgacccacuacgugucacaaaucggaggcuucccaaaccaggcagaagacggugggcugccccagaguggaaggauaguaguggauuauaugguccagaaaagcggcaagacaggcacuauuaccuaccaacgggggauccucuuaccucagaaaguguggugcgccucuggacgcuccaagguuauuaaagguucacugccacuuaucggcgaggcugacuguuugcaugaaaaguaugggggacugaacaagagcaaacccuacuacacaggcgagcacgccaaggcaaucgguaauugcccgauuugggugaaaacuccucuaaagcucgcuaacgggaccaaauauagacccccagccaagcugcuuaaggagaggggcuuuuucggagcgauagccggcuuucuggaagggggaugggaggguaugaucgcaggcuggcauggguacacaagucacggagcucacggcgucgccguggcugccgauuugaaaucuacccaggaagcaauuaauaagaucacuaaaaaccucaauucccugagcgaguuagaaguaaagaaccugcagcggcucucgggugccauggacgagcuucauaaugagauacuggaauuggaugagaaaguugacgaccuacgcgcugauacgauuucuucccaaaucgaacuggcggugcuccugucaaacgaggggaucauuaauagugaagacgagcaccuucuggcauuggagcgaaagcucaagaaaaugcugggcccuagcgccgucgaaaucggaaacggcuguuucgagacaaagcauaaaugcaaucagaccugcuuagauagaauugcugccgggacuuuuaacgcaggagaguucucccugcccaccuuugacucucuaaauauaacagccgcuagccucaacgaugacggucuggauaaucacaccauccuuuuguauuacucaacugccgcaaguucccuggcggugacacucaugauugcuaucuucaucgucuauauggugagcagggacaacguuucuuguucaauuugccuguga

SEQ ID NO: 150589 - RNA, 1755 nt, Artificial Sequence
  derived and/or modified sequence opt3 from hemagglutinin__InfluenzaB__EPI271545
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaucucuguauggcgauagcaauccucaaaaguuuacauccucagcgaacggggugaccacgcacuacgucagucagaucggagacuucccagaucagaccgaggacggcggucucccccagagcgggagaauaguuguggauuauaugaugcaaaagccuggaaaaacaggcacuauuguauaccagaggggcguguuacugccacagaaggucuggugcgcaucugggcgguccaaagugaucaagggaucacuucccuugauuggugaagccgacugucugcaugagaaauacggcgggcuaaauaagagcaaaccguauuacaccggagaacacgcuaaggccaucggcaacugcccuaucuggguuaagacaccccucaaacuggcaaacgguacuaaguaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaccucaaaucuacacaggaggccaucaauaagauuaccaagaacuuaaauucccugagcgaacuggaggugaaaaaccuccaaagacuuucgggcgcaauggaugaacugcauaaugagaucuuggagcuagacgaaaagguagaugaccugagggccgauacuauaucuucccagauugagcucgcuguucugcuuucaaacgaagguaucaucaauagugaggacgaacaccuguuggcgcucgagcggaaacugaagaaaauguuagggcccagcgcaguggauauuggcaacggauguuucgagacgaagcacaagugcaaucagacaugccuggaccguaucgccgcuggcaccuuuaacgccggggaguucucccuaccaacuuuugauucucucaauauuaccgcagccagccugaacgacgauggacuugacaaucauacaauauugcuguauuacucaaccgcugccaguucccucgcagucacucugaugcuugcgaucuucauuguguauauggucagccgcgacaacgugucuuguucaaucugccuguga

SEQ ID NO: 150590 - RNA, 1755 nt, Artificial Sequence
  derived and/or modified sequence opt3 from hemagglutinin__InfluenzaB__AGB08329
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagauccagaugaaaucucuguauggcgauagcaauccucaaaaguuuacuuccucagcgaacggggugacaacccacuacgucagucagauaggagacuucccagaucagacggaggacggcggucucccccagagcgggagaauuguuguggauuauaugaugcaaaagccuggaaaaaccggcacaaucguauaccagaggggcguguuacugccacagaaggucuggugcgcaucugggcgguccaaagugauuaagggaucacuucccuugaucggugaagccgacugucugcaugagaaauacggcgggcuaaauaagagcaaaccguauuacacuggagaacacgcuaaggccaucggcaacugcccuauuuggguuaagaccccucucaaacuggcaaacgguacaaaguaucgcccacccgcuaaacuucugaaggagcgaggguuuuucggcgccauagcgggauuuuuggagggcgggugggaaggaaugaucgccgguuggcacggcuacacuucccauggggcacacggaguggcugucgccgcugaccucaaaucuacccaggaggccauuaauaagaucacaaagaaccugaauaguuuaagcgaacuggaggugaaaaaccuccaaagacuuucgggcgcaauggaugaacugcauaaugagauauuggagcuagacgaaaagguagaugaccugagggccgauaccauuucuucccagaucgagcucgcuguucugcuuucaaacgaagguaucauuaauagugaggacgaacaccuguuggcgcucgagcggaaacugaagaaaauguuagggcccagcgcaguggauaucggcaacggauguuucgagacuaagcacaagugcaaucagacgugccuggaccguauugccgcuggcacauuuaacgccggggaguucucccuaccaaccuuugauucucucaauauaacugcagccagccugaacgacgauggacuugacaaucauaccaucuugcuguauuacucaacagcugccaguucccucgcagucacccugaugcuugcgauuuucaucguguauauggucagccgcgacaacgugucuuguucaaucugccuguga

SEQ ID NO: 150591 - RNA, 1755 nt, Artificial Sequence; identical to SEQ ID NO: 148771
  derived and/or modified sequence opt3 from hemagglutinin__InfluenzaB__EPI294880

SEQ ID NO: 150592 - RNA, 1752 nt, Artificial Sequence; identical to SEQ ID NO: 148482
  derived and/or modified sequence opt3 from hemagglutinin__InfluenzaB__CY018765

SEQ ID NO: 150593 - RNA, 1401 nt, Artificial Sequence
  derived and/or modified sequence opt3 from neuraminidase_glycoprotein__InfluenzaB__AAN39743
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauugcgcaaacgccucgaaugugcaagcgguaaaccacucagcuacugaggaaaugaccuuccugcugccggagcccgaauggacauauccuagacucagcugucagggaaguaccuuucagaaggccuuacugaucuccccacauagguucggugaggcaaaaggcaauucugcuccccuuauuauccgggaaccuuuuauugcuugcgggccaaaggaguguauccacuucgcauugacucauuacgccgcucagcccggaggcuauuacaacgguacacgcgaggaccgaaauaaacugcgucaccuaauaagcgugaaccucgggaagaucccuaccgucgaaaauuccauuuuucauauggccgcguggucaggaagugcaugccacgauggcagagaguggacguauaucggcguggacgggccagauagcaacgcccugauuaagaucaaauacggagaagccuacacugacaccuaucacucuuacgccaauaacauacuuaggacacaagaguccgcauguaauugcauugguggcgauuguuaucugaugaucacugacgggucagcuagcggaauuagucggugccgcuucuugaagaucagagagggcaggaucauuaaagaaauauuuccgaccggucggguugagcauacagaagaguguaccugcggguucgccucuaacaagacgaucgaaugugugugccgcgauaauuccuacacugcgaaacgacccuuugucaagcucaacguggagacagacaccgccgagauuagacugaugugcacugaaacauauuuagauaccccuaggccagacgauggaagcaucacgggccccugugagucgaauggcgacaaggggaacggagguauaaaaggcggguucguacaccagcggauggcaucucguauuggacgcugguacuccagaaccaugucaaagacaaaaaggaugggcauggaacuguauguuaaguacgacggugauccuuggacugacagugaugcucucgccccaagcggggugauggucuccauggaggaacccggcugguacucuuuuggauucgagaucaaagacaagaaaugcgaugugccguguaucggcauugagauggugcaugacgggggaaagaagaccuggcacagcgcugccacagcaaucuauugccuuauggguucaggccagcuguugugggauacugucaccgggguugacauggcccuauga

SEQ ID NO: 150594 - RNA, 1401 nt, Artificial Sequence
  derived and/or modified sequence opt3 from neuraminidase_glycoprotein__InfluenzaB__AAN39747
augcugcccagcaccauccagacacucauucuuuuccugacuuccggcgggguguuguuaucucuguacgucucagcccuacucaguuaucugcuuuacagcgacauacuguugaaguuuuccccuacgaaaaucauugcuccaaccaugucucucgauugcgcaaacgccucgaauguucaagcggugaaccacucagcuacaaaggagaugacuuuccugcugccggaacccgaguggaccuauccuagacucagcugucagggaaguacauuucagaaagccuuacugaucuccccacauagguucggugaagcaaagggcaauucugcuccccuuauuauccgggagccuuuuauagccugcgggccaaaagaauguaagcacuucgcauugacccauuacgccgcucagcccggaggcuauuacaacgguacucgcgaggaccgaaauaagcugcgucaccuaaucagcguaaaccucgggaaaauuccuacaguggaaaauuccaucuuucauauggccgcguggucaggaagugcaugccacgauggcagagaguggaccuauauuggcgucgacgggccagauagcaacgcccugaucaagauaaaauacggagaggcuuacacggacacuuaucacucuuacgccaauaacauucuuaggacccaagaauccgcauguaauugcaucgguggcgauuguuaucugaugauuacagacgggucagcuagcggaaucaguaagugccgguucuugaaaauccgcgagggcagaauuauaaaggagaucuuuccgacugguaggguggaacauaccgaggaauguacaugcggguucgccucuaacaagaccauugagugugcgugccgggauaauuccuacacggccaaacgccccuuuguuaagcucaacguggaaacugacacagcagagauccgacugaugugcaccaaaacuuauuuagauacaccuagaccagacgauggaagcauaaccggccccugugagucgaauggcgacaaggggucuggagguauuaaaggcggguucguccaccagaggauggcuuccaagaucggacggugguacucacguacgaugaguaaaaccaagcgcaugggcauggaacuguaugugaaguacgacggugauccuuggacagacagcgaugcccucgcuccauccgggguaaugguuucuaucgaggaacccggcugguacagcuuuggauucgagauuaaagacaagaaaugcgaugugccguguaucggcauugaaaugguccaugacgggggaaagaaaacuuggcacucagccgcaaccgccauauauugccuuauggguaguggccagcuguugugggauacagugacugggguggacauggcucuauga

SEQ ID NO: 150595 - RNA, 1401 nt, Artificial Sequence
  derived and/or modified sequence opt3 from neuraminidase_glycoprotein__InfluenzaB__AAN39749
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauugcgcaaacgccucgaaugugcaagcgguaaaccacucagcuacugaggaaaugaccuuccugcugccggagcccgaauggacauauccuagacucagcugucagggaaguaccuuucagaaggccuuacugaucuccccacauagguucggugaggcaaaaggcaauucugcuccccuuauuauccgggaaccuuuuauugcuugcgggccaaaggaguguaaacacuucgcauugacucauuacgccgcucagcccggaggcuauuacaacgguacacgcgaggaccgaaauaagcugcgucaccuaaucagcgugaaccucgggaagauaccuaccgucgaaaauuccaucuuucauauggccgcguggucaggaagugcaugccacgauggcagagaguggacguauauuggcguggacgggccagauagcaacgcccugaucaaaauuaaguacggagaagccuacacugacaccuaucacucuuacgccaauaacauccuuaggacacaagaguccgcauguaauugcauagguggcgauuguuaucugaugauuacugacgggucagcuagcggaaucagucggugccgcuucuugaaaauuagagagggcaggaucaucaaggaaauuuuuccgaccggucggguugagcauacagaagaguguaccugcggguucgccucuaacaaaacgauagaaugugcgugccgcgauaauuccuacacugccaagcgacccuuugugaagcucaacgucgagacagacaccgcagagaucagacugaugugcacugaaacauauuuagauaccccuaggccagacgauggaagcauuacgggccccugugagucgaauggcgacaaagggaacggagguaucaagggcggguucgugcaccagcggauggcuucucguauaggacgcugguacuccagaaccaugucaaaaacaaagaggaugggcauggaacuguauguaaaauacgacggugauccuuggacugacagugaugcccucgcuccaagcgggguuaugguguccauggaggaacccggcugguacucuuuuggauucgagauuaaggacaaaaagugcgaugucccguguaucggcaucgagauggugcaugacgggggaaagaaaaccuggcacagcgccgcaacagccauuuauugccuuauggguucaggccagcuguugugggauacugugaccggggucgacauggcucuauga

SEQ ID NO: 150596 - RNA, 1401 nt, Artificial Sequence
  derived and/or modified sequence opt3 from neuraminidase_glycoprotein__InfluenzaB__AAN39751
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauugcgcaaacgccucgaaugugcaagcgguaaaccacucagcuacugaggaaaugaccuuccugcugccggagcccgaauggacauauccuagacucagcugucagggaaguaccuuucagaaggccuuacugaucuccccacauagguucggugaggcaaaaggcaauucugcuccccuuauuauccgggaaccuuuuauugcuugcgggccaaaggaguguaaacacuucgcauugacucauuacgccgcucagcccggaggcuauuacaacgguacacgcgaggaccgaaauaagcugcgucaccuaaucagcgugaaccucgggaagauaccuaccgucgaaaauuccaucuuucauauggccgcguggucaggaagugcaugccacgauggcagagaguggacguauauuggcguggacgggccagauagcaacgcccugaucaaaauuaaguacggagaagccuacacugacaccuaucacucuuacgccaauaacauccuuaggacacaagaguccgcauguaauugcauagguggcgauuguuaucugaugauuacugacgggucagcuagcggaaucagucggugccgcuucuugaaaauuagagagggcaggauccucaaggaaaucuuuccgaccggucggguugagcauacagaagaguguaccugcggguucgccucuaacaaaacgauugaaugugcgugccgcgauaauuccuacacugccaagcgacccuuugugcagcugaacgucgagacagacaccgcagagauaagauuaaugugcacugaaacauaucuggauaccccuaggccagacgauggaagcaucacgggccccugugagucgaauggcgacaaggggaacggagguauuaaaggcggguucgugcaccagcggauggcuucucguaucggacgcugguacuccagaaccaugucaaagacaaaaaggaugggcauggaccucuauguaaaguacgauggugacccuuggacugauagugacgcccuugcuccaagcgggguuaugguguccauggaggaacccggcugguacucuuuuggauucgaaauaaaagauaagaaaugcgacgucccguguauuggcaucgagauggugcaugaugggggaaagaagaccuggcacagcgccgcaacagccaucuauugccugauggguucaggccaguugcuaugggacacugugaccggggucgauauggcucuguga

SEQ ID NO: 150597 - RNA, 1401 nt, Artificial Sequence
  derived and/or modified sequence opt3 from neuraminidase_glycoprotein__InfluenzaB__AAN39753
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauugcgcaaacgccucgaaugugcaagcgguaaaccacucagcuacugaggaaaugaccuuccugcugccggagcccgaauggacauauccuagacucagcugucagggaaguaccuuucagaaggccuuacugaucuccccacauagguucggugaggcaaaaggcaauucugcuccccuuauuauccgggaaccuuuuauugccugcgggccaaaggaguguaaacacuucgcauugacucauuacgccgcucagcccggagaguauuacaacggcacacgcgaagaccgaaauaagcugcgucaccuaaucagcgugaaccucgguaagauaccuaccgucgaaaauuccaucuuucauauggccgcguggucagggagugcaugccacgauggaagagaauggacguauauuggcguggacggcccagauagcaacgcccugaucaaaauuaaguacggggaggcuuacacugacaccuaucacucuuacgccaauaacauccuuaggacacaagaguccgcauguaauugcauaggaggugauuguuaucugaugauuacugacggcucagcuagcgggaucagucggugccgcuucuugaaaauuagagaaggaaggaucaucaaggagauuuuuccgaccggccggguugaacauacagaggaauguaccugcgguuucgccucuaacaaaacgauagagugugcgugccgcgauaauuccuacacugccaagcgacccuuugugaagcucaacgucgagacagacaccgcagaaaucagacugaugugcacugagacauauuuagauaccccuaggccagacgaugggagcauuacgggacccugugaaucgaauggcgacaaaggcaacgggggaaucaaggguggcuucgugcaccagcggauggcuucucguauagggcgcugguacuccagaaccaugucaaaaacaaagaggaugggaauggagcuguauguaaaauacgacggcgauccuuggacugacagugaugcccucgcuccaagcgguguuaugguguccauggaggagcccgggugguacucuuuuggcuucgagauuaaggacaaaaagugcgaugucccguguaucggaaucgaaauggugcaugacggcgggaagaaaaccuggcacagcgccgcaacagccauuuauugccuuaugggaucaggucagcuguugugggauacugugaccggcgucgacauggcucuauga

SEQ ID NO: 150598 - RNA, 1401 nt, Artificial Sequence
  derived and/or modified sequence opt3 from neuraminidase_glycoprotein__InfluenzaB__AAN39759
augcugcccagcaccauccagacacucacucuuuuccugacguccggcgggguguuguuaucucuguacgucucagccagucuaagcuaucuccuguacuccgacauucuucugaaguugucuccuaccgagauaacagcuccaacuaugccgcucgauugcgcaaacgccucgaauguucaagcggugaacagaucagcuaccaaaggaguaacacugcugcuccccgaaccugaguggaccuauccaagguuaagcugucccgguaguacuuuucagaaggcccugcuuaucuccccucaccgguucggcgaaacaaaaggaaauucugcaccauugauuauccgcgagcccuuuauugccugcgggccuaaggaauguaaacauuucgcucugacccacuacgcagcccagccaggcgguuauuacaacgggacgcgagaggaccguaauaagcuaagacaucucaucagcgugaagcugggaaaaauaccgacugucgagaacuccaucuuucacauggcugccuggucaggcagugcgugccaugauggcaaggaauggaccuauauugggguggacggacccgauagcaaugcacuucugaaaaucaaguacggugaggccuacacagacacuuaucacucuuacgcuaacaauauuuugaggacccaggaauccgccuguaacugcaucggcgggaauuguuaucucaugauaacagauggaucagcaagcggcauuagugagugccgguuccugaaaauccgcgaggguagaauuaucaaggaaaucuuuccuaccgggaggguuaagcacacggaggaauguacuugcggauucgcuucuaacaaaacaauugagugugccugccgggacaauuccuacaccgcgaagcgcccauuugugaaauuaaacgucgaaacugauacagccgagauacgacugaugugcaccgagacguaucucgacacccccagaccugaugacggcagcaucacaggcccaugugaaucgaauggggauaagggaucugguggcauuaaagggggauucgugcaucaaaggauggaguccaagaucggccggugguacucacguacuaugaguaaaaccaagcgcauggguauggggcuuuauguaaaguacgacggcgaccccuggacagauagcgacgcacuggcuuuguccggaguuauggugucuauagaggaaccgggcugguacagcuuuggguucgaaauuaaagauaagaaaugcgacgucccuuguaucggaaucgagauggugcacgaugguggcaaggagacuuggcauucagccgcuaccgccauuuauugccuaauggggaguggacagcugcucugggacacagugaccggcgucgauauggcacuguga

SEQ ID NO: 150599 - RNA, 1401 nt, Artificial Sequence
  derived and/or modified sequence opt3 from neuraminidase_glycoprotein__InfluenzaB__AAN39761
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaaggaauguaaacauuuugcuuugacccacuacgcagcccagccuggcgguuauuacaacgggacgcgagaggaccguaauaagcugagacaucuaaucagcgugaagcucggaaaaauaccaacugucgagaacuccaucuuccacauggcugccuggucaggcagugcgugccaugauggcagggaauggaccuauauugggguggacggaccggauagcaaugcacugcuuaagaucaaauacggugaggccuacacagacacuuaucacucuuacgcuaagaacauucugcggacccaagaauccgccuguaauugcaucggcggggauuguuauuugaugauaacagacggaucagcaagcggcauuagugagugccgcuuucucaaaaucagagaggguaggauuaucaaggaaaucuuccccaccgggcggauuaagcacacggaggaauguacuugcggauuugcuucuaacaaaacaauagagugugccugccgcgauaauuccuacaccgcgaagcgaccuuucguuaaacugaacguggaaacugacacagccgagaucagauuaaugugcaccgagacguaucuggauaccccaaggcccgacgauggcagcauuacaggcccuugugaaucgaauggggacaagggaucugguggcaucaaagggggauuuguccaucagcggauggcauccaagauaggccguugguacucacgcacuaugaguaaaaccaagagaauggguauggggcucuaugugaaguacgacggcgauccauggacagacagcgaggcucuugcccuguccggaguaaugguuucuauggaggaacccggcugguacagcuucggguuugaaauuaaagauaagaaaugcgacgugccguguaucggaaucgagaugguccacgaugguggcaagacuaccuggcauucagcugccacagcaauuuauugcuugauggggaguggacagcuacugugggacaccgugacuggcguggauauggcccucuga

SEQ ID NO: 150600 - RNA, 1401 nt, Artificial Sequence
  derived and/or modified sequence opt3 from neuraminidase_glycoprotein__InfluenzaB__AAN39769
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcagagaauggacuuauaucggcguggacgggccagauucuaacgcccugauuaagaucaaauacggagaggcuuacaccgacacauaucacuccuacgccaauaacauacuuaggacucaagaaucagcaugcaauuguauugguggcgauugcuaucugaugaucaccgacgggagcgcuaguggaauuucuaagugucgguuuuugaaaauccgcgagggcagaaucauuaaggagauauucccgacagguagggucgaacauaccgaggaaugcacguguggguuugccuccaacaagacuaucgagugcgcgugucgggauaauagcuacacagccaaacgccccuucgugaagcucaacguugaaaccgacacugcagagauucgacugaugugcacagagaccuauuuagauacgccuagaccagacgauggaucgaucaccggccccugcgaaucuaauggcgacaaaggguccggagguauaaagggcggguuugugcaccagaggauggcuucaaaaauuggacggugguacagucguacaaugagcaagacuaaacgcaugggcauggagcuguaugucaaguacgacggugauccuuggaccgacuccgaugcccucgcuccaucuggggugaugguaagcaucgaggagcccggcugguacucauucggauucgaaaucaaggacaaaaagugugauguuccgugcauuggcaucgagauggugcaugacgggggaaaaacaacuuggcacagugccgcaaccgccauuuauugucuuauggguuccggccagcuguugugggauacagucaccgggguggacauggcucuauga

SEQ ID NO: 150601 - RNA, 1401 nt, Artificial Sequence
  derived and/or modified sequence opt3 from neuraminidase_glycoprotein__InfluenzaB__AAN39771
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcagagaauggacuuauaucggcguggacgggccagauucuaacgcccugauuaagaucaaauacggagaggcuuacaccgacacauaucacuccuacgccaauaacauacuuaggacucaagaaucagcaugcaauuguauugguggcgauugcuaucugaugaucaccgacgggagcgcuaguggaauuucuaagugucgguuuuugaaaauccgcgagggcagaaucgucaaggagauuuucccgacagguaggguggaacauaccgaggaaugcacguguggguuugccuccaacaagacuauagagugcgcgugucgggauaauagcuacacagccaaacgccccuucguuaagcucaacguggaaaccgacacugcagagauccgacugaugugcacagagaccuauuuagauacgccuagaccagacgauggaucgauuaccggccccugcgaaucuaauggcgacaaaggguccggagguaucaagggcggguuuguccaccagaggauggcuucaaaaauaggacggugguacagucguacaaugagcaagacuaaacgcaugggcauggagcuguaugugaaguacgacggugauccuuggaccgacuccgaugcccucgacccaucugggguaaugguuagcauugaggagcccggcugguacucauucggauucgaaaucaaggauaaaaagugugacgugccgugcaucggcauugagaugguccaugaugggggaaaaacaacuuggcacagugcugccaccgcaaucuauugucuuauggguuccggccagcuguugugggacacaauuaccgggguggauauggcccuauga

SEQ ID NO: 150602 - RNA, 1401 nt, Artificial Sequence
  derived and/or modified sequence opt3 from neuraminidase_glycoprotein__InfluenzaB__AAN39773
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaacuucgggaaaaucccuacgguagaaaauucaauuuuucauauggccgcguggaguggaagcgcaugucacgauggcagagaauggacuuauaucggcguggacgggccagauucuaacgcccucauuaagaucaaauacggagaggcuuacaccgacacauaucacuccuacgccaauaacauacugaggacucaagaaucagcaugcaauuguauugguggcgauugcuaucuuaugaucaccgacgggagcgcuaguggaauuucuaagugucgguuccugaaaauccgcgagggcagaaucgucaaggagauuuuuccgacagguaggguggaacauaccgaggaaugcacguguggguucgccuccaacaagacuauagagugcgcgugucgggauaauagcuacacagccaaacgccccuuuguuaaguugaacguggaaaccgacacugcagagauccgacucaugugcacagagaccuaucuggauacgccuagaccagacgauggaucgauuaccggccccugcgaaucuaauggcgacaaaggguccggagguaucaagggcggguucguccaccagaggauggcuucaaaaauaggacggugguacagucguacaaugagcaagacuaaacgcaugggcauggaguuauaugugaaguacgacggugauccuuggaccgacuccgaugcccuggcuccaucugggguaaugguuagcauugaggagcccggcugguacucauucggauuugaaaucaaggacaaaaagugugaugugccgugcaucggcauugagaugguccaugacgggggaaaaacaacuuggcacagugccgcaaccgccaucuauugucucauggguuccggccagcuucugugggauacaauuaccgggguggacauggcuuuguga

SEQ ID NO: 150603 - RNA, 1401 nt, Artificial Sequence
  derived and/or modified sequence opt3 from neuraminidase_glycoprotein__InfluenzaB__AAN39775
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcaaggaauggacuuauaucggcguggacgggccagauucuaacgcccugauuaaaaucaaguacggagaggcuuacaccgacacauaucacuccuacgccaauaacauacuuagaacucaagaaucagcaugcaauuguauugguggcgauugcuaucugaugaucaccgacgggagcgcuaguggaauuucuaaauguagguuuuugaagauccgggagggccgcaucauuaaggagauauucccgacagguagagucgaacauaccgaggaaugcacguguggguuugccuccaacaaaacuaucgagugcgcguguagggauaauagcuacacagccaagcggcccuucgugaaacucaacguugaaaccgacacugcagagauucgccugaugugcacagagaccuauuuagauacgccucgaccagacgauggaucgaucaccggccccugcgaaucuaauggcgacaagggguccggagguauaaaaggcggguuugugcaccagagaauggcuucaaagauuggaaggugguacagucggacaaugagcaaaacuaagcguaugggcauggagcuguaugucaaguacgacggugauccuuggaccgacuccgaugcccucgcuccaucuggggugaugguaagcaucgaggagcccggcugguacucauucggauucgaaaucaaagacaagaaaugugauguuccgugcauuggcaucgagauggugcaugacgggggaaagacaacuuggcacagugccgcaaccgccauuuauugucuuauggguuccggccagcuguugugggauacagucaccgggguggacauggcucuauga

SEQ ID NO: 150604 - RNA, 1401 nt, Artificial Sequence
  derived and/or modified sequence opt3 from neuraminidase_glycoprotein__InfluenzaB__AAN39777
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugccgcccgaaccugaguggaccuauccaaggcugagcugucccgguaguacuuuccagaaggcccucuuaaucuccccucaccgguuuggcgaaacaaaaggaaauucugcaccacugauuauccgcgagcccuucauugccugcgggccuaaggaauguaaacauuuugcucuuacccacuacgcagcccagccaggcgguuauuacaacgggacgcgagaggaccguaauaaguugagacaucugaucagcgugaagcuaggaaaaauaccgacugucgagaacuccaucuuccacauggcugccuggucaggcagugcgugccaugauggcagggaauggaccuauauugggguggacggacccgauagcaaugcacuccugaagaucaaauacggugaggccuacacagacacuuaucacucuuacgcuaagaacauucuucggacccaagaauccgccuguaauugcaucggcggggauuguuaucugaugauaacagacggaucagcaagcggcauuagugagugccgcuuuuugaaaaucagagaggguaggauuaucaaggaaaucuucccuaccgggcggguuaagcacacggaggaauguacuugcggauuugcuucuaacaaaacaauugagugugccugccgcgauaauuccuacaccgcgaagcgaccauucgugaaacucaacgucgaaacugacacagccgagauaagacugaugugcaccgagacguauuuagauacccccaggccugacgauggcagcaucacaggcccaugugaaucgaaugggaacaagggaucugguggcauuaaagggggauuugugcaucagcggauggcauccaagaucggccguugguacucacgcacuaugaguaaaaccaagagaauggguauggggcuguauguaaaguacgacggcgaccccuggacagauagcgaggcucucgcccuuuccggaguuauggugucuauggaggaaccgggcugguacagcuucggguuugaaauaaaagacaagaaaugcgaugucccuuguauuggaaucgagauggugcacgacgguggcaagacuaccuggcauucagcugccacagcaaucuauugccugauggggaguggacaguugcuaugggauaccgugacuggcgucgacauggcccuguga

SEQ ID NO: 150605 - RNA, 1401 nt, Artificial Sequence; identical to SEQ ID NO: 150600
  derived and/or modified sequence opt3 from neuraminidase_glycoprotein__InfluenzaB__AAN39779

SEQ ID NO: 150606 - RNA, 1401 nt, Artificial Sequence
  derived and/or modified sequence opt3 from neuraminidase_glycoprotein__InfluenzaB__AAN39781
augcugcccagcaccauccagacacucacucuuuuccugacguccggcgggguguuguuaucucuguacgucucagccagucuaagcuaucuccuguacuccgacauucuucugaaguuuucuucgaccgagauaacagcuccuacuaugccauugaacugcgcaaaugccucaaacguucaagcggugaaucacagcgcuaccaaaggaguaacacucccgcugcccgaaccugaguggaccuauccaagacugaguugucccgguuccacuuuccagaaggcccucuuaaucucuccucauagguuuggcgaaacaaaagggaacagcgcaccacugauuauccgggagcccuucauugccugcggaccuaaggaauguaaacacuuugcucuuacccauuacgcagcccagccaggcgguuauuacaaugggacgcgcgaggaucgaaacaaguugcgucaccugaucuccgugaagcuaggaaaaauaccgacugucgaaaauucaaucuuccauauggcugccuggaguggcagcgcgugccacgacggcagagaauggaccuauauugggguggauggacccgacucuaacgcacuccugaagaucaaauacggugaggccuacacagauacuuaucacuccuacgcuaauaacauucuuaggacccaggaaucagccuguaauugcaucggcggggacuguuaucugaugauaacagauggaagcgcaaguggcguuucugagugccgguuuuugaagauucgcgaggguagaaucauuaaagaaaucuucccuaccgggaggguggagcauacggaagaguguacuugcggauuugcuuccaacaagacaaucgaaugugccugccgggacaauagcuacaccgcgaagcgcccauucgucaaacucaacguggagacugauacagccgagauucgacugaugugcaccgaaacguauuuagacacccccagaccugaugacggcucgauaacaggcccaugugagucuaauggggauaagggauccgguggcaucaaagggggauuuguacaccaaaggauggcaucaaagauuggccggugguacagucguacuaugagcaaaaacaagcgcauggguauggggcuguauguuaaauacgacggcgaccccuggaucgauuccgacgcucucacccuuucuggagugauggucagcauggaggagccgggcugguacucauucggguuugaaauaaaggauaagaaaugcgacgugccuuguauuggaaucgagauggugcaugaugguggcaaggagacauggcacagugccgcuacugccaucuauugccugaugggguccggacaguugcuaugggacaccgucacaggcguuaacauggcacuguga

SEQ ID NO: 150607 - RNA, 1401 nt, Artificial Sequence
  derived and/or modified sequence opt3 from neuraminidase_glycoprotein__InfluenzaB__AAN39783
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaaggaauguaaacauuuugcuuugacccacuacgcagcccagccuggcgguuauuacaacgggacgcgagaggaccguaauaagcugagacaucuaaucagcgugaagcucggaaaaauaccaacugucgagaacuccaucuuccacauggcugccuggucaggcagugcgugccaugauggcagggaauggaccuauauugggguggacggaccggauagcaaugcacugcuuaagaucaaauacggugaggccuacacagacacuuaucacucuuacgcuaagaacauucugcggacccaagaauccgccuguaauugcaucggcggggauuguuauuugaugauaacagacggaucagcaagcggcauuagugagugccgcuuucucaaaaucagagaggguaggauuaucaaggaaaucuuccccaccgggcggguuaagcacacggaggaauguacuugcggauuugcuucuaacaaaacaauugagugugccugccgcgauaauuccuacaccgcgaagcgaccuuucgugaaacugaacgucgaaacugacacagccgagauaagauuaaugugcaccgagacguaucuggauaccccaaggcccaaugacggcagcaucacaggcccuugugaaucgaacggggauaagggaucugguggcauuaaagggggauuugugcaucagcggauggcauccaagaucggccguugguacucacgcacuaugaguaaaaccaagagaauggguauggggcucuauguaaaguacgacggcgacccauggacagauagcgaggcucuugcccuguccggaguuauggugucuauggaggaacccggcugguacagcuucggguuugaaauaaaagacaagaaaugcgaugucccguguauuggaaucgagauggugcacgacgguggcaagacuaccuggcauucagcugccacagcaaucuauugcuugauggggaguggacagcuacugugggauaccgugacuggcgucgacauggcccucuga

SEQ ID NO: 150608 - RNA, 1401 nt, Artificial Sequence
  derived and/or modified sequence opt3 from neuraminidase_glycoprotein__InfluenzaB__AAN39785
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauuaugcaaacgccucgaaugugcaagcgguaaaccacucagcuacugaggaaaugaccuuccugcugccggagcccgaauggacauacccuagacucagcugccagggaaguaccuuucagaaggccuuacugaucuccccacauagguucggugaggcaaaaggcaauucugcuccccuuauuauccgggaaccuuuuauugcuugugggccaaaggagugcaaacacuucgcauugacucauuaugccgcucagcccggaggcuacuauaacgguacacgcgaggaccgaaauaagcugcgucaccuaaucagcgugaaccucgggaagauaccuaccgucgaaaauuccaucuuucauauggccgcguggucaggaagugcaugucacgauggcagagaguggacguacauuggcguggacgggccagauagcaacgcccugaucaaaauuaaguacggagaagccuauacugacaccuaccacucuuaugccaauaacauccuuaggacacaagaguccgcaugcaauuguauagguggcgauugcuaccugaugauuacugacgggucagcuagcggaaucagucggugucgcuucuugaaaauuagagagggcaggaucaucaaggaaauuuuuccgaccggucggguugagcauacagaagagugcaccuguggguucgccucuaacaaaacgauagaaugcgcgugucgcgauaauuccuauacugccaagcgacccuuugugaagcucaacgucgagacagacaccgcagagaucagacugaugugcacugaaacauacuuagauaccccuaggccagacgauggaagcauuacgggccccugcgagucgaauggcgacaaagggucuggagguaucaagggcggguucgugcaccagcggaugaccucccguauaggacgcugguauucaagaacaaugaguaaaacuaagaggaugggcauggaacuguacguaaaauacgacggugauccuuggaccgacagcgaugcucucgccccauccgggguuauggugucuauggaggaacccggcugguauagcuuuggauucgagauuaaggacaaaaagugugaugucccgugcaucggcaucgagauggugcaugacgggggaaagaaaacauggcacucagcugccacugcaauuuacugucuuauggguaguggccagcuguugugggauaccgugacaggggucgacauggcccuauga

SEQ ID NO: 150609 - RNA, 1401 nt, Artificial Sequence
  derived and/or modified sequence opt3 from neuraminidase_glycoprotein__InfluenzaB__AAN39787
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauuaugcaaacgccucgaaugugcaagcgguaaaccacucagcuacugaggaaaugaccuuccugcugccggagcccgaauggacauacccuagacucagcugccagggaaguaccuuucagaaggccuuacugaucuccccacauagguucggugaggcaaaaggcaauucugcuccccuuauuauccgggaaccuuuuauugcuugugggccaaaggagugcaaacacuucgcauugacucauuaugccgcucagcccggaggcuacuauaacgguacacgcgaggaccgaaauaagcugcgucaccuaaucagcgugaaccucgggaagauaccuaccgucgaaaauuccaucuuucauauggccgcguggucaggaagugcaugucacgauggcagagaguggacguacauuggcguggacgggccagauagcaacgcccugaucaaaauuaaguacggagaagccuauacugacaccuaccacucuuaugccaauaacauccuuaggacacaagaguccgcaugcaauuguauagguggcgauugcuaccugaugauuacugacgggucagcuagcggaaucagucggugucgcuucuugaaaauuagagagggcaggaucaucaaggaaauuuuuccgaccggucggguugagcauacagaagagugcaccuguggguucgccucuaacaaaacgauagaaugcgcgugucgcgauaauuccuauacugccaagcgacccuuugugaagcucaacgucgagacagacaccgcagagaucagacugaugugcacugaaacauacuuagauaccccuaggccagacgauggaagcauuacgggccccugcgagucgaauggcgacaaagggaacggagguaucaagggcggguucgugcaccagcggauggcuucucguauaggacgcugguauuccagaaccaugucaaaaacaaagaggaugggcauggaacuguacguaaaauacgacggugauccuuggacugacagugaugcccucgcuccaagcgggguuaugguguccauggaggaacccggcugguauucuuuuggauucgagauuaaggacaaaaagugugaugucccgugcaucggcaucgagauggugcaugacgggggaaagaaaaccuggcacagcgccgcaacagccauuuacugucuuauggguucaggccagcuguugugggauacugugaccggggucgacauggcucuauga

SEQ ID NO: 150610 - RNA, 1401 nt, Artificial Sequence
  derived and/or modified sequence opt3 from neuraminidase_glycoprotein__InfluenzaB__AAN39795
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacacgcggaaauucugcaccacuuauuauccgagagcccuucauugccugcgggccuaaagaauguaagcauuuugcuuugacccacuacgcagcccagccaggcgguuauuacaacgggacgcgugaggacagaaauaaacugaggcaucuaaucagcgugaagcucggaaagauaccgacugucgagaacuccaucuuccacauggcugccuggucaggcagugcgugccaugauggccgggaauggaccuauauugggguggacggacccgauagcaaugcacugcuuaaaaucaaguacggugaggccuacacagacacuuaucacucuuacgcuaacaauauucugcgcacccaggaauccgccuguaacugcaucggcggggauuguuauuugaugauaacagacggaucagcaagcggcaccaguaaaugcagauuucucaagauuagggagggucggaucauuaaagagaucuucccuacggggcgcguugaacacacugaggaauguacaugcggauuugcuucuaauaagaccaucgagugugccugccgagauaacaauuacacugcgaagagaccauucgugaaacugaacgucgaaacagacgccgcagagauuagguuaaugugcaccgagacguaucuggauacaccccggccugacgauggcuccauaaccggcccaugugaaagcaauggggacaagggacgugguggcaucaaagggggauuugugcaucaacgcauggcuucgaagauuggcagaugguacucuaggacuauguccaaaaccgagcggauggguauggaacucuauguaaaguacgacggggaucccuggacagacucagaugcccuugcucugaguggcguuauggugagcauggaggaaccgggaugguacuccuucggcuuugagaucaaagacaagaagugcgaugucccuuguauagggauugagauggugcacgacggagguaaaaagacuuggcauucugccgcaaccgccaucuauugcuugaugggcagcgggcagcuacugugggauacagugaccggagucgacauggcucucuga

SEQ ID NO: 150611 - RNA, 1401 nt, Artificial Sequence; identical to SEQ ID NO: 150595
  derived and/or modified sequence opt3 from neuraminidase_glycoprotein__InfluenzaB__AAN39797

SEQ ID NO: 150612 - RNA, 1401 nt, Artificial Sequence
  derived and/or modified sequence opt3 from neuraminidase_glycoprotein__InfluenzaB__AAN39799
augcugcccagcaccauccagacacucacucuuuuccugacguccggcgggguguuguuaucucuguacgucucagcccuacucaguuaucugcuuuacagcgacguucuguugaaguuuuccccuaccaaaauuauagcuccaacaaugucucucgauugcgcaaacgccucgaaugugcaagcgguaaaccacucagcuacugaggaaaugaccuuccugcugccggagcccgaauggacauauccuagacucagcugucagggaaguaccuuucagaaggccuuacugaucuccccacauagguucggugaggcaaaaggcaauucugcuccccuuauuauccgggaaccuuuuauugccugcgggccaaaggaguguaaacacuucgcauugacucauuacgccgcucagcccggaggcuauuacaacgguacacgcgaggaccgaaauaagcugcgucaccuaaucagcgugaaccucgggaagauaccuaccgucgaaaauuccaucuuucauauggccgcguggucaggaagugcaugccacgauggcagagaguggacguauauuggcguggacgggccagauagcaacgcccugaucaaaauugaauacggagaggcuuacacugacaccuaucacucuuacgccuauaauauccuuaggacacaagaguccgcauguaacugcauagguggcgauuguuaccugaugauuacugacgggucagcuagcggaaucaguaagugccgguucuugaaaauucgcgaaggcagaaucaucaaggagauuuuuccgaccgguaggguugaacauacagaggaauguaccugcggguucgccucuaauaaaacgauagagugugcgugccgggauaacuccuauacugccaagcgccccuuugugaagcucaaugucgagacagacaccgcagaaauccgacugaugugcacugagacauacuuagauaccccuagaccagacgauggaagcauuacgggccccugugaaucgaacggcgacaaagggucuggagguaucaagggcggguucgugcaccagaggauggcuuccaaaauaggacggugguauucacguaccaugaguaagacaaaacgcaugggcauggagcuguacguaaaguacgacggugauccuuggacugacagcgaugcccucgcuccauccgggguuauggugucuauggaggaacccggcugguauagcuuuggauucgagauuaaagacaagaagugcgaugucccguguaucggcaucgaaauggugcaugacggggguaaaaagaccuggcacucagccgcaacagccauuuacugccuuaugggaaguggccagcuguugugggauacugugaccggggucgacauggcucuauga

SEQ ID NO: 150613 - RNA, 1401 nt, Artificial Sequence
  derived and/or modified sequence opt3 from neuraminidase_glycoprotein__InfluenzaB__AAN39801
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaaugcgcaagcuguuaacagaucagccaccaaaggagugacacuccugcugcccgaaccugaguggaccuauccaaggcucagcugucccgguaguacuuuccagaaggcauuacugaucuccccucaccgguuuggcgaaacaaaaggaaauucugccccacuuauuauccgcgagcccuucauugcuugcgggccuaaggaauguaaacauuuugcauugacccacuacgccgcucagccaggcgguuauuacaacgggacgcgagaggaccguaauaagcugagacaucuaaucagcguaaagcucggaaaaauaccgacuguggagaacuccaucuuccacauggccgcguggucaggcagugcaugccaugauggcaaggaauggaccuauauuggggucgacggacccgauagcaaugcccugcuuaaaaucaaguacggugaggcuuacacagacacuuaucacucuuacgccaacaauauucugaggacccaggaauccgcauguaacugcaucggcgggaauuguuauuugaugauaacagauggaucagcuagcggcauuagugagugccgguuucucaaaauccgcgaggguagaauuaucaaggaaaucuucccuaccgggagggugaagcacacggaggaauguacuugcggauuugccucuaacaaaacaauugagugugcgugccgggacaauuccuacaccgccaagcgcccauucguuaaacugaacguggaaacugauacagcagagauacgauuaaugugcaccgagacguaucuggacacccccagaccugaugacggcagcaucacaggcccaugugaaucgaauggggauaagggaucugguggcauuaaagggggauuuguccaucaaaggauggcuuccaagaucggccggugguacucacguacuaugaguaaaaccaagcgcauggguauggggcucuaugugaaguacgacggcgaccccuggacagauagcgacgcccuugcucuguccggaguaaugguuucuauggaggaaccgggcugguacagcuucggguuugagauaaaagauaagaaaugcgacgugccuuguauuggaaucgaaaugguccacgaugguggcaaggagacuuggcauucagccgcaaccgccaucuauugcuugauggggaguggacagcuacugugggacacagugaccggcguggauauggcucucuga

SEQ ID NO: 150614 - RNA, 1401 nt, Artificial Sequence
  derived and/or modified sequence opt3 from neuraminidase_glycoprotein__InfluenzaB__AAN39803
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaaaaguuccguuggauugcgcaaacgccucgaaugugcaagcgguaaacagaucagcuacuaagggaaugacccuccugcugagcgaacccgaguggacauauccuaggcucaguugucaggguuccaccuuccagaaagccuuacugaucucuccacaccgguuuggcgaaacucgcgggaauagcgcaccccuuauuauccgagagccuuucauugccugcggaccaaaggaauguaaacauuuugcuuugacacacuacgcagcccagcccggcgguuauuacaacgggacccgugaggacagaaauaagcugaggcaucuaaucuccgugaagcucggaaaaauaccuacggucgagaacucaaucuuccacauggcugccuggaguggcagcgcgugccaugauggccgggaauggacuuauauugggcuggacggaccagauucuaaugcacuuaucaagauuaaauacggugaggccuacaccgacacauaucacuccuacgcuaacaauauccugcgcacucaagaaucagccuguaacugcauaggcggggauuguuauuugaugauuaccgacggaagcgcaaguggcaucucuaagugcagauuucucaaaauuagggagggucggaucaucaaggagauuuucccgacagggcgcguggaacacaccgaggaauguacgugcggauuugcuuccaauaagacuauagagugugccugccgagauaacagcuacacagcgaaaagacccuucguuaagcugaauguggaaaccgacacugccgagaucagguuaaugugcacagagaccuaucuggauacgccucggccagacgauggcucgauuaccggccccugugaaucuaacggggacaaaggacgugguggcaucaaagggggauuuguccaucagcgcauggcauccaagauaggcagaugguacucaaggacaaugaguaagacugagcggauggguauggaacucuaugugaaauacgacggggauccuuggaccgacagcgaugcucuugccccauccggcguaaugguuucuaugaaggagcccggaugguacagcuucggcuuugaaauuaaggacaaaaagugcgaugugccguguaucgggaucgagaugguccacgacggagguaaagagacauggcauucagcugccacugcaauuuauugccugaugggcagugggcaguugcuaugggauaccgugacaggaguggacauggcccuguga

SEQ ID NO: 150615 - RNA, 1401 nt, Artificial Sequence
  derived and/or modified sequence opt3 from neuraminidase__InfluenzaB__ABA02232
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgaaaauaacgcacugcuuaaaaucaaguacggcgaggccuacacagauacuuaucacagcuacgcuaauaacauucugaggacccaggaaucugccuguaauugcaucgggggaaacuguuauuugaugauaacagacggcuccgcaucagguauuagcgagugccgguuucucaaaauccgcgaggggagaauuaucaaggaaaucuucccuaccggaaggguuaagcacacggaggaauguacuugcggcuuugcuaguaauaaaacaauugagugugccugccgggauaacucuuacaccgcgaagcgcccauucgugaaacugaaugucgaaacugacacagccgagauacgauuaaugugcaccgagacguaucuggauacccccagaccugacgauggcuccaucacagggccaugugaaagcaacggagacaaggguucgggcgggauuaaaggaggcuuugugcaucaaaggauggcaucuaagaucggucggugguacucccguacuaugucaaaaaccaagcgcauggggaugggccucuauguaaaguacgauggagaccccuggacagacagugaugcucuugcccugagcggcguuaugguguccauggaggaaccggggugguacucuuucggauuugagauaaaagacaagaaaugcgaugucccuuguauugguaucgaaauggugcacgacggcgggaaggagacuuggcauagcgcugccaccgcaaucuauugcuugaugggaucaggccagcuacugugggauacagugaccggugucgacauggcccucuga

SEQ ID NO: 150616 - RNA, 1401 nt, Artificial Sequence
  derived and/or modified sequence opt3 from neuraminidase__InfluenzaB__ABI84039
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaaguacacggaagaguguacuugcggcuuugcuaguaacaagacaaucgaaugugccugccgggacaauucuuauaccgcgaaacgcccauucgucaagcugaacguggagacugauacagccgaaauucgauuaaugugcaccgacacguaccuggauacccccagaccugacgauggcuccauaacagggccaugugagagcaacggagacaaagguucgggcgggaucaagggaggcuuuguacaccaaaggauggcaucuaaaauuggucggugguauucccguacuaugucaaagaccgagcgcauggggaugggccucuacguuaaauacgacggagaucccugggcugacagugaugcccuugcuuucagcggcgugauggucuccaugaaggaaccggggugguauucuuuuggauucgagaucaaggacaaaaagugcgaugugccuuguauagguauugaaauggugcaugacggcgggaaagagacauggcacagcgccgcaacugccaucuacugccugaugggaucaggccaguugcuaugggauaccgucacagguguugacauggcucuguga

SEQ ID NO: 150617 - RNA, 1401 nt, Artificial Sequence
  derived and/or modified sequence opt3 from neuraminidase__InfluenzaB__ABI84051
augcugcccagcaccauccagacacucacucuuuuccugacguccggcgggguguuguuaucucuguacgucucagccagucuaagcuaucuccuguacuccgacauucuucugagauuuucucaaaccgagauaacagcuccuaucaugccauuggauugcgcaaacgccucgaauguucaggcggugaaccacucagcuacuaagggaguaacccuccugcugccggaacccgaguggacauauccuaggcucagcuguccagguaguaccuuccagaaagccuuacugauuucuccccaucgguuuggcgaaacuaagggaaauuccgcaccucuuaucauucgcgagccauucaucgccugcgggcccaaagaauguaagcacuuugcuuugacacauuacgcagcccagccuggcgguuauuacaacgggacccgagaggaccguaauaaacugagacaccuaauaagcgugaagcucggaaagaucccaacggucgagaacuccauuuuccauauggcugccuggucaggcagugcgugccacgauggcagggaauggacuuauaucgggguggacggaccggauagcaaugcacugcuuaaaauuaaguacggugaggccuacaccgacacauaucacucuuacgcuaaaaacauccugcggacucaagaauccgccuguaauugcauaggcggggauuguuauuugaugauuaccgacggacccgcaucaggcaucagcgagugccgcuuucucaagauuagagaggguaggaucaucaaagaaauuuucccuacagggcggguuaagcauaccgaggaauguacgugcggauuugcuaguaacaagacuauagagugugccugccgcgauaauucuuacacagcgaaacgaccauucgugaagcugaacgucgaaaccgacacugccgagaucagauuaaugugcacagagaccuaucuggauacgcccaggccuaaugacggcuccauuaccggcccaugugaaagcaacggggauaaaggaucggguggcaucaaagggggauuugugcaccagcggauggcaucuaagauaggccguugguacucccgcacaaugucaaagacuaaaagaauggguauggggcucuauguaaaguacgacggcgaccccuggaccgauagugaggcucuugcccugagcggaguuaugguguccauggaggaaccgggcugguacucuuucggguuugaaauuaaggacaaaaagugcgaugucccuuguaucggaaucgagauggugcaugacgguggcaaaacaacuuggcacagcgcugccaccgcaauuuauugcuugauggggucaggacagcuacugugggauacagugaccggcgucgacauggcccucuga

SEQ ID NO: 150618 - RNA, 1401 nt, Artificial Sequence
  derived and/or modified sequence opt3 from neuraminidase__InfluenzaB__ABI84062
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaauuaugccguuggauugcgcaaacgccucgaauguucaagcggugaacagaucaacaacuaaaggaguaacccuccugcugcccgaaccugaguggacauauccaaggcucagcugucccgguaguaccuuccagaaggcuuuacugaucuccccucaccgguuuggcgaaacuaaaggaaauucugccccacuuauuauccgcgagcccuucauagcaugcgggccuaaggaauguaaacauuuugccuugacacacuacgcugcacagccaggcgguuauuacaacgggacccgaggagaccguaauaagcugagacaucuaaucagcgugaagcucggcaaaauuccgacggucgagaacuccaucuuccacauggccgcuuggucaggcagugccugccaugaugggaaggaguggacuuauauuggaguggacggucccgauaauaacgcgcugcuuaaaaucaaguacggcgaagcauacaccgacacauaucacagcuacgccaauaacauacugaggacucaggagucugcuuguaauugcauugggggaaacuguuauuugaugaucaccgauggcccugccuccgguauuucagaaugccgguuucucaaaauccgcgaggggagaaucauuaaggagauauucccaacaggaaggguuaagcacaccgaagaguguacgugcggcuuugcaagcaauaaaacuaucgaaugugcuugccgggacaacaguuacacagccaagcgccccuucgugaaacugaaugucgagaccgauacugcggaaauucgauuaaugugcacagagaccuaucuggacacgccuagaccagaugacggcucuaucaccgggcccugugaguccaacggagauaaggguagcggcgggauaaaaggaggcuuugugcaucaaaggauggccucgaagauuggucggugguacucucguacaauguccaaaacugaacgcauggggaugggccucuauguaaaguacgacggagacccgugggcagauucagacgcucuugcccugaguggcguuauggugagcauggaggaaccugggugguacuccuucggauuugagaucaaggauaaaaagugcgacguccccuguaucgguauugaaauggugcacgauggcgggaaagagaccuggcauucugcugccacagcaaucuauugcuugaugggaagcggccagcuacugugggacacugugaccggugucgauauggcccucuga

SEQ ID NO: 150619 - RNA, 1401 nt, Artificial Sequence
  derived and/or modified sequence opt3 from neuraminidase__InfluenzaB__ABL76280
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugaacugcgcaaaugccucgaacguucaagcggugaauagaucagcuaccaaaggaguaacacuccugcugcccgaaccugaguggaccuauccaaggcucagcugucccgguaguacuuuccagaaggccuuacugaucuccccucaccgguuuggcgaaacaaaagggaacucugcaccacuuauuauccgcgagcccuucauugccugcggaccuaaggaauguaaacauuuugcuuugacccacuacgcagcccagccaggcgguuauuacaaugggacgcgagaggaucguaacaagcugagacaucuaaucagcgugaagcucggaaaaauaccgacugucgaaaauuccaucuuccacauggcugccuggucaggcagugcgugccaugacggcagggaauggaccuauauugggguggauggacccgacagcaacgcacugcuuaagaucaaauacggugaggccuacacagauacuuaucacucuuacgcuaauaacauucugcggacccaggaauccgccuguaauugcaucggcggggacuguuauuugaugauaacagauggaucagcaagcggcauuagugagugccgcuuucucaagaucagagaggguaggauuaucaaagaaaucuucccuaccgggcggguugagcacacggaagaguguacuugcggauuugcuucuaacaagacaauugaaugugccugccgcgacaauuccuacaccgcgaagcgaccauucgugaaacugaacgucgagacugauacagccgagauaagauuaaugugcaccgaaacguaucuggacacccccaggccugaugacggcagcaucacaggcccaugugagucgaauggggauaagggaucugguggcauuaaagggggauuugugcaucaacggauggcauccaagaucggccguugguacucacgcacuaugaguaaaaccaagagaauggguauggggcucuauguaaaauacgacggcgaccccuggauagauagcgacgcucuuacacuguccggaguuauggugucuauggaggagccgggcugguacagcuucggguuugaaauuaaggauaagaaaugcgacgucccuuguaucggaaucgagauggugcacgaugguggcaagaaaacuuggcauucagccgcuaccgccauuuauugcuugauggggaguggacagcuacugugggacacagugaccggcgucgauauggcacucuga

SEQ ID NO: 150620 - RNA, 1401 nt, Artificial Sequence
  derived and/or modified sequence opt3 from neuraminidase__InfluenzaB__ABL76302
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgagaggaccguaauaagcugagacaucuaaucucugugaagcucggaaaaauacccacugucgagaacagcaucuuccacauggcugccugguccggcucagcgugccaugauggcagggaauggaccuauauugggguggacggaccugauaguaaugcacugcuuaagaucaaauacggugaggccuacacagacacuuaucacagcuacgcuaacaauauucugcggacccaggaaucugccuguaacugcaucggcgggaauuguuauuugaugauaacagauggauccgcaucaggcauuagcgagugccgcuuucucaagaucagagaggguaggauuaucaaagaaaucuucccaaccgggcggguuaagcacacggaggaauguacuugcggauuugcuaguaacaagacaauugagugugccugccgcgacaauucuuacaccgcgaaacgacccuucgugaagcugaacgucgaaacugauacagccgagauaagauuaaugugcaccgagacguaucuggacaccccuaggccagaugacggcuccaucacaggccccugugaaagcaauggggauaaaggaucggguggcauuaaagggggauuugugcaucaacggauggcaucuaagaucggccguugguacucccgcacuaugucaaagaccaaaagaauggguauggggcucuauguaaaguacgacggcgacccguggacagauagugacccucuugcucugagcggaguuaugguguccauggaggaacccggcugguacucuuucggguuugagauaaaggauaaaaagugcgacgucccauguauuggaaucgaaauggugcacgaugguggcaaagagacuuggcauagcgccgcuaccgccaucuauugcuugauggggucaggacagaugcuaugggacacagugaccggcgucgauauggcacuguga

SEQ ID NO: 150621 - RNA, 1401 nt, Artificial Sequence
  derived and/or modified sequence opt3 from neuraminidase__InfluenzaB__ABL76313
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguugaacugcgcaaaugccucgaacguucaagcggugaauagaucagcuacuaagggaguaaccuucccccucccugaaccagaguggacauaucccaggcugagcuguccugguaguaccuuucagaaagcccugcucaucuccccacaccgguucggcgaaacuaaggggaacucugcacccuuaauuauccgcgagccuuuuauugccugcggaccaaaagaauguaagcauuucgcucugacacacuacgcagcccagccgggcgguuauuacaaugggacccgagaggaucguaacaaacuuagacauuugaucagcgugaagcugggaaagauacccacggucgaaaauuccaucuuucacauggcugccuggucaggcagugcgugccaugacggcagggaauggacuuauauugggguggauggaccugacagcaacgcacuacucaaaaucaaguacggugaggccuacaccgauacauaucacucuuacgcuaauaacauucugcggacucaggaauccgccuguaauugcaucggcggggacuguuaucuuaugauaaccgauggaucagcaagcggcauuagugagugccgcuuccugaaaaucagagaggguaggauuaucaaggaaaucuuuccaacagggcggguugagcacaccgaagaguguacgugcggauucgcuucuaacaagacuauugaaugugccugccgcgacaauuccuacacagcgaaacgacccuuugugaaguugaacgucgagaccgauacugccgagauaagacucaugugcacagaaaccuaucuggacacgccuaggccagaugacggcagcaucaccggccccugugagucgaauggggauaaaggaucugguggcauuaaagggggauucgugcaucaacggauggcauccaagaucggccguugguacucacgcacaaugaguaagacuaaaagaauggguaugggguuauauguaaaguacgacggcgacccguggauagauagcgacgcucugacccucuccggaguuauggugucugucgaggagccuggcugguacagcuuuggguucgaaauuaaggauaaaaagugcgacgugcccuguaucggaaucgagauggugcacgaugguggcaaaacaacuuggcauucagccgcuaccgccauuuauugccuuauggggaguggacagcuguugugggacacagucaccggcguugauauggcacuauga

SEQ ID NO: 150622 - RNA, 1401 nt, Artificial Sequence
  derived and/or modified sequence opt3 from neuraminidase__InfluenzaB__ABL76335
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugaacugcgcaaaugccucgaacguucaagcggugaauagaucagcuaccaaaggaguaacacucccccugccugaaccagaguggaccuaucccaggcugagcuguccugguaguacuuuccagaaggcccucuuaaucuccccacaccgguuuggcgaaacaaaagggaacucugcaccccugauuauccgcgagccuuucauugccugcggaccaaaggaauguaaacauuuugcucuuacccacuacgcagcccagccgggcgguuauuacaaugggacgcgagaggaucguaacaaguugagacaucugaucagcgugaagcuaggaaaaauacccacugucgaaaauuccaucuuccacauggcugccuggucaggcagugcgugccaugacggcagggaauggaccuauauugggguggauggaccugacagcaacgcacuccugaagaucaaauacggugaggccuacacagauacuuaucacucuuacgcuaauaacauucuucggacccaggaauccgccuguaauugcaucggcggggacuguuaucugaugauaacagauggaucagcaagcggcauuagugagugccgcuuuuugaagaucagagaggguaggauuaucaaagaaaucuucccaaccgggcggguugagcacacggaagaguguacuugcggauuugcuucuaacaagacaauugaaugugccugccgcgacaauuccuacaccgcgaagcgacccuucgugaaacucaacgucgagacugauacagccgagauaagacugaugugcaccgaaacguauuuagacaccccuaggccagaugacggcagcaucacaggccccugugagucgaauggggauaagggaucugguggcauuaaagggggauuugugcaucaacggauggcauccaagaucggccguugguacucacgcacuaugaguaaaaccaagagaauggguauggggcuguauguaaaauacgacggcgacccguggauagauagcgacgcucucacacuuuccggaguuauggugucuauggaggagccuggcugguacagcuucggguuugaaauuaaggauaagaaaugcgacguccccuguaucggaaucgagauggugcacgaugguggcaagacuaccuggcauucagccgcuacagccauuuauugccugauggggaguggacaguugcuaugggacaccgugacuggcgucgauauggcacuguga

SEQ ID NO: 150623 - RNA, 1401 nt, Artificial Sequence
  derived and/or modified sequence opt3 from neuraminidase__InfluenzaB__ABL76346
augcugcccagcaccauccagacacucacucuuuuccugacguccggcgggguguuguuaucucuguacgucucagccagucuaagcuaucuccuguacuccgacauucuucugaaguuuucuccuaaagagauaaccacaccaacuaugccguugaacugcgcuaaugcaucgaacguucaagccgugaauagaucagcgaccaagggaguaacacuccugcugcccgaaccugaguggaccuauccaaggcucagcugucccgguaguacuuuccagaaggcuuuacugaucuccccucaccgguuuggcgaaacaaaggggaacucugccccacuuauuauccgcgagcccuucauugcaugcggaccuaaagaauguaagcauuuugccuugacccacuacgcugcacagccaggcgguuauuacaaugggacgcgagaggaucguaacaagcugagacaucuaaucagcgugaaacucggaaagauaccgacugucgaaaauuccaucuuccacauggccgcuuggucaggcagugccugccaugacggcagggaauggaccuauauugggguggauggacccgacagcaacgcgcugcuuaaaaucaaguacggugaggcauacacagauacuuaucacucuuacgccaauaacauucugcggacccaggaauccgcuuguaauugcaucggcggggacuguuauuugaugauaacagauggaucagccagcggcauuagugagugccgcuuucucaaaaucagagaggguaggauuaucaaggaaaucuucccuaccgggcggguugagcacacggaagaguguacuugcggauuugcaucuaacaagacaauugaaugugcuugccgcgacaauuccuacaccgccaaacgaccauucgugaagcugaacgucgagacugauacagcggagauaagauuaaugugcaccgaaacguaucuggacacccccaggccugaugacggcagcaucacaggcccaugugagucgaauggggauaaaggaucugguggcauuaaagggggauuugugcaucaacggauggccuccaaaaucggccguugguacucacgcacuaugaguaagaccaaaagaauggguauggggcucuauguaaaguacgacggcgaccccuggauagauagcgacgcacuuacacuguccggaguuauggugucuauggaggagccgggcugguacagcuucggguuugaaauuaaggauaaaaagugcgacgucccuuguaucggaaucgagauggugcacgaugguggcaaaacuaccuggcauucagcugccacagcuauuuauugcuugauggggaguggacagcuacugugggacaccgugacuggcgucgauauggcccucuga

SEQ ID NO: 150624 - RNA, 1401 nt, Artificial Sequence; identical to SEQ ID NO: 150623
  derived and/or modified sequence opt3 from neuraminidase__InfluenzaB__ABL76357

SEQ ID NO: 150625 - RNA, 1401 nt, Artificial Sequence
  derived and/or modified sequence opt3 from neuraminidase__InfluenzaB__ABL76368
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguuaagcacacggaggaauguacuugcggauuugcuucuaacaaaacaauugagugugccugccgggacaauuccuacaccgcgaagcgcccauucgugaaacugaacgucgaaacugauacagccgagauacgauuaaugugcaccgagacguaucuggacacccccagaccugaugacggcagcaucacaggcccaugugaaucgaauggggauaagggaucugguggcauuaaagggggauuugugcaucaaaggauggcauccaagaucggccggugguacucacguacuaugaguaaaaccaagcgcauggguauggggcucuauguaaaguacgacggcgaccccuggacagauagcggagcucuugcccuguccggcguuauggugucuauggaggaaccggggugguacagcuucggauuugagauaaaagacaagaaaugcgaugucccuuguauugguaucgaaauggugcacgacggcgggaaggagacuuggcauucagcugccaccgcaaucuauugcuugaugggaaguggccagcuacugugggauacagugaccggugucgacauggcccucuga

SEQ ID NO: 150626 - RNA, 1404 nt, Artificial Sequence
  derived and/or modified sequence opt3 from neuraminidase__InfluenzaB__ABL76379
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacauuccuccugcugcccgaaccugaguggaccuauccaaggcucagcugucccgguaguacuuuucagaaggccuuacugaucuccccucaccgguucggcgaaacaaaaggaaauucugcaccacuuauuauccgcgagcccuuuauugccugcgggccuaaggaauguaaacauuucgcuuugacccacuacgcagcccagccaggcgguuauuacaacgggacgcgaggagaccguaauaagcugagacaucuaaucagcgugaagcucggcaaaauaccgacugucgagaacuccaucuuucacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuccucaaaauccgcgaggggagaauuaucaaggagaucuuuccuaccggaaggguuaagcacacggaagaguguacuugcggcuucgcuucuaacaaaacaauugaaugugccugccgggacaauuccuacaccgcgaagcgcccauuugugaaacugaacgucgagacugauacagccgaaauacgauuaaugugcaccgagacguaucuggacacccccagaccugaugacggcagcaucacagggccaugugagucgaauggagauaaggguucuggcgggauuaaaggaggcuucgugcaucaaaggauggcauccaagaucggucggugguacucacguacuaugaguaaaaccaagcgcauggggaugggccucuauguaaaguacgacggagaccccuggacagauagcgacgcucuugcccuguccggcguuauggugucuauggaggaaccggggugguacagcuuuggauucgaaauaaaagauaagaaaugcgacgucccuuguauugguaucgagauggugcacgauggcgggaaggaaacuuggcauucagcugccaccgcaaucuauugcuugaugggaaguggccagcuacugugggacacagugaccggugucgauauggcccucuga

SEQ ID NO: 150627 - RNA, 1401 nt, Artificial Sequence
  derived and/or modified sequence opt3 from neuraminidase__InfluenzaB__ABL76390
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucaagcaccaaaggaguaacauuccuccugcccgaaccugaguggaccuauccaaggcugaguugucccgguuccacuuuucagaaggcucucuuaaucucuccucaccgguucggcgaaacaaaagggaauagcgccccacugauuauccgcgagcccuuuauugcaugcggaccuaaggaauguaaacauuucgcccuuacccacuacgcugcacagccaggcgguuauuacaacgggacgcgagaggaccguaauaaguugagacaucugaucuccgugaagcuaggaaaaauaccgacugucgagaacucaaucuuucacauggccgcuuggaguggcagcgccugccaugauggcaaggaauggaccuauauugggguggacggacccgauucuaaugcgcuccugaaaaucaaguacggugaggcauacacagacacuuaucacuccuacgccaacaauauucuuaggacccaggaaucagcuuguaacugcaucggcgggaauuguuaucugaugauaacagauggaagcgccaguggcauuucugagugccgguucuugaaaauccgcgaggguagaauuaucaaggaaaucuuuccuaccgggaggguuaagcacacggaggaauguacuugcggauucgcauccaacaaaacaauugagugugcuugccgggacaauagcuacaccgccaagcgcccauuugugaaacucaacgucgaaacugauacagcggagauacgacugaugugcaccgagacguauuuagacacccccagaccugaugacggcucgaucacaggcucuugugaauccgauggggacaagggaucagguggcauuaaagggggauucgugcaucaaaggauggccaguaagaucggccggugguacagccguacuauguccaaaaccaagcgcauggguauggggcuguauguaagauacgacggcgauccauggacagacucuagcgcacucgcucuuucaggaguuauggugaguauggaggaacccggcugguacuccuuuggguucgagauaaaggauaaaaagugcgacgucccguguauuggaaucgaaauggugcacgaugguggcaaagagacuuggcauagcgccgcuaccgccaucuauugccugauggggucuggacaguugcuaugggacacagugaccggcgucgauauggcacuguga

SEQ ID NO: 150628 - RNA, 1401 nt, Artificial Sequence
  derived and/or modified sequence opt3 from neuraminidase__InfluenzaB__ABL76412
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugauccccgaaccugaguggaccuauccaaggcugagcugucccgguaguacuuuccagaaggcccucuuaauuuccccucaccgguuuggcgaaacaaaaggaaauucugcaccacugaucauucgcgagcccuucaucgccugcgggccuaaggaauguaaacauuuugcucuuacccacuacacggcacagccaggcgguuauuacaacgggacucgaggagaccguaauaaguugagacaucugauaagcgugaagcuaggcaaaaucccgaccgucgagaacuccauuuuccacauggccgcuuggucaggcagugccugccaugaugggaaggaguggacauauaucggaguggacggucccgauagcaaugcgcuccugaaaauuaaguacggcgaagcauacacugacaccuaucacucuuacgccaacaauauccuuaggacacaggaguccgcuuguaacugcauagggggaaauuguuaucugaugauuaccgauggcucagccagcgguaucagugaaugccgguuuuugaaaauucgcgaggggagaaucaucaaggagauuuucccuacgggaaggguuaagcacacugaagaguguacaugcggcuuugcaucuaacaaaaccauagaaugugcuugccgggacaauuccuacacugccaagcgcccauucgugaaacucaacgucgagacagauaccgcggaaauccgacugaugugcacggagaccuauuuagacacacccagaccugaugacggcagcauuacugggccaugugagucgaauggagauaaggguucuggcgggaucaaaggaggcuuugugcaucaaaggauggccuccaagauaggucggugguacucacguaccaugaguaaaacaaagcgcauggggaugggccuguauguaaaguacgacggagaccccuggacugauagcgacgcacucgcucuuuccggcguuauggugucuauggaggaaccggggugguacagcuucggauuugaaauuaaagauaagaaaugcgacgucccuuguaucgguaucgagauggugcacgauggcgggaaggaaaccuggcauucagccgcuacagccauuuauugccugaugggaaguggccaguugcuaugggacaccgugacuggugucgauauggcacuguga

SEQ ID NO: 150629 - RNA, 1401 nt, Artificial Sequence
  derived and/or modified sequence opt3 from neuraminidase__InfluenzaB__ABL76423
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaaggaauguaaacacuuugcuuugacccauuacgcagcccagccaggcgguuauuacaacgggacgcgcggagaccgaaauaagcugcgucaccuaaucagcgugaagcucggcaaaauaccgacugucgagaacuccaucuuccauauggcugccuggucaggcagugcgugccacgaugggaaggaguggaccuauauuggaguggacggucccgauagcaaugcacugcuuaaaaucaaguacggcgaagccuacacagacacuuaucacucuuacgcuaacaauauucugagaacccaggaguccgccuguaacugcaucgggggaaauuguuauuugaugauaacagauggcucagcaagcgguauuagugaaugcagguuucucaaaauccgggaggggcgcauuaucaaggagaucuucccuaccggaagaguuaagcauacggaagaguguacuugcggcuuugcuucuaacaaaacaauugaaugugccugcagggacaauuccuacaccgcgaagcggccauucgugaaacugaacgucgagacugauacagccgaaauacgcuuaaugugcaccgagacguaucuggacacaccccgaccugaugacggcagcaucaccgggccaugugagucgaauggagauaaggguucuggcgggauuaaaggaggcuuugugcaccaaagaauggcauccaagaucgguaggugguacucacggacuaugaguaaaaccaagcguauggggaugggccucuauguaaaguacgacggagaccccuggacagauagcgacgcucuugccuucuccggcguuauggugucuauggaggaaccggggugguacagcuuuggauucgaaauaaaagauaagaaaugcgacgucccuuguauugguaucgagauggugcaugauggcgggaaggaaacuuggcacucagcugccaccgcaaucuauugccugaugggaaguggccaguugcuaugggacacagugaccggugucgauauggcccuguga

SEQ ID NO: 150630 - RNA, 1401 nt, Artificial Sequence
  derived and/or modified sequence opt3 from neuraminidase__InfluenzaB__ABL76434
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccugggcugauagugacgcccuugcucugagcggcguuaugguguccauggaggaaccggggugguacucuuucggauuugaaauaagagauaaaaagugcgacgucccuuguauugguaucgagauggugcacgauggcgggaaagaaacauggcauagcgccgcaacugccaucuauugcuugaugggaucaggccagcuacugugggacaccgugacaggugucgauauggcucucuga

SEQ ID NO: 150631 - RNA, 1401 nt, Artificial Sequence
  derived and/or modified sequence opt3 from neuraminidase__InfluenzaB__ABL76456
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaaagcuccugcugcccgaaccugaguggacauauccaaggcucagcugucccgguaguaccuuccagaaagccuuacugaucuccccucaccgguuuggcgaaacuaagggaaauucugcaccacuuauuauccgcgagcccuucauugccugcgggccuaaagaauguaagcauuuugcuuugacacacuacgcagcccagccaggcgguuauuacaacgggacccgaggagaccguaauaagcugagacaucuaaucagcgugaaacucggcaagauaccgacggucgagaacuccaucuuccacauggcugccuggucaggcagugcgugccaugaugggaaagaguggacuuauauuggaguggacggucccgauaauaacgcacugcuuaagaucaaauacggcgaagccuacaccgacacauaucacagcuacgcuaauaacauucugaggacucaggagucugccuguaauugcaucgggggaaacuguuauuugaugauaaccgauggcuccgcaucagguguuagcgaaugccgguuucucaagauucgcgaggggagaaucauuaaggagaucuucccuacaggaagggugaaacacaccgaagaguguacgugcggcuuugcuaguaauaagacuaucgaaugugccugccgggacaacucuuacacagcgaaacgcccauucgucaagcugaauguggagaccgauacugccgaaauucgauuaaugugcacagagaccuaucuggacacgcccagaccugaugacggcuccauaaccgggccaugugagagcaacggagauaaagguucgggcgggaucaagggaggcuuuguacaucaaaggauggcaucuaaaauuggucggugguacucccguacaaugucaaagacuaagcgcauggggaugggccucuauguuaaauacgacggagaccccugggcugauagugacgcccuugcucugagcggcgugauggucuccauggaggaaccggggugguacucuuucggauuugaaaucaaggauaaaaagugcgacgugccuuguauagguauugagauggugcacgauggcgggaaagaaaccuggcauagcgccgcaacagccaucuauugcuugaugggaucaggccagcuacugugggacacugucaccgguguugauauggcucucuga

SEQ ID NO: 150632 - RNA, 1401 nt, Artificial Sequence
  derived and/or modified sequence opt3 from neuraminidase__InfluenzaB__ABL76467
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccugggcugauagugacgcccuugcucugagcggcguuaugguguccauggaggaaccggggugguacucuuucggauuugaaauaaaagauaagaaaugcgacgucccuuguauugguaucgagauggugcacgauggcgggaaggaaacauggcauagcgccgcaacugccaucuauugcuugaugggaucaggccagcuacugugggacaccgugacaggugucgauauggcucucuga

SEQ ID NO: 150633 - RNA, 1401 nt, Artificial Sequence
  derived and/or modified sequence opt3 from neuraminidase__InfluenzaB__ABL76478
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaaagcuccugcugcccgaaccugaguggacauauccaaggcucagcugucccgguaguaccuuccagaaagccuuacugaucuccccucaccgguuuggcgaaacuaagggaaauucugcaccacuuauuauccgcgagcccuucauugccugcgggccuaaagaauguaagcauuuugcuuugacacacuacgcagcccagccaggcgguuauuacaacgggacccgaggagaccguaauaagcugagacaucuaaucagcgugaaacucggcaagauaccgacggucgagaacuccaucuuccacauggcugccuggucaggcagugcgugccaugaugggaaagaguggacuuauauuggaguggacggucccgauaauaacgcacugcuuaagaucaaauacggcgaagccuacaccgacacauaucacagcuacgcuaauaacauucugaggacucaggagucugccuguaauugcaucgggggaaacuguuauuugaugauaaccgauggcuccgcaucagguguuagcgaaugccgguuucucaagauucgcgaggggagaaucauuaaggagaucuucccuacaggaagggugaaacacaccgaagaguguacgugcggcuuugcuaguaauaagacuaucgaaugugccugccgggacaacucuuacacagcgaaacgcccauucgucaagcugaauguggagaccgauacugccgaaauucgauuaaugugcacaaaaaccuaucuggacacgcccagaccugaugacggcuccauaaccgggccaugugagagcaacggagauaaggguucgggcgggaucaaaggaggcuuuguacaucaaaggauggcaucuaagauuggucggugguacucccguacaaugucaaagacuaaacgcauggggaugggccucuauguuaaguacgacggagaccccugggcugauagugacgcccuugcucugagcggcgugauggucuccauggaggaaccggggugguacucuuucggauuugagaucaaagauaagaaaugcgacgugccuuguauagguauugaaauggugcacgauggcgggaaggagaccuggcauagcgccgcaacagccaucuauugcuugaugggaucaggccagcuacugugggacacugucaccgguguugauauggcucucuga

SEQ ID NO: 150634 - RNA, 1401 nt, Artificial Sequence
  derived and/or modified sequence opt3 from neuraminidase__InfluenzaB__ABL76522
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgagacguaucuggacacccccagaccugaugacggcuccauaacagggccaugugagagcaacggagauaaagguucgggcgggaucaagggaggcuuuguacaucaaaggauggcaucuaaaauuggucggugguacucccguacuaugucaaagaccgaacgcauggggaugggccucuauguuaaauacgacggagaccccugggcugauagugacgcccuugcucugagcggcgugauggucuccauggaggaaccggggugguacucuuucggauuugagaucaaggauaagaaaugcgacgugccuuguauagguauugaaauggugcacgauggcgggaaggagacauggcauagcgccgcaacugccaucuauugcuugaugggaucaggccagcuacugugggacaccgucacagguguugauauggcucucuga

SEQ ID NO: 150635 - RNA, 1401 nt, Artificial Sequence
  derived and/or modified sequence opt3 from neuraminidase__InfluenzaB__ABL76533
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggaaacgaggagaccguaacaagcugagacaucuaaucagcgugaagcucggcaaaauaccgacggucgaaaauuccaucuuccacauggcugccuggucaggcagugcgugccaugaugggaaggaguggacuuauauuggaguggacggucccgauaacaaugcacugcuuaaaaucaaguacggcgaggccuacaccgacacauaucacagcuacgcuaacaauauucugaggacucaggagucugccuguaacugcaucgggggaaauuguuauuugaugauaaccgauggcuccgcaucagguguuagcgaaugccgguuucucaaaauucgcgaggggagaaucauuaaggagaucuucccuacaggaagggugaagcacaccgaagaguguacgugcggcuuugcuaguaacaaaacuaucgaaugugccugccgggacaauucuuacacagcgaagcgcccauucgucaaacugaacguggagaccgauacugccgaaauucgauuaaugugcacagagaccuaucuggacacgcccagaccugaugacggcuccauaaccgggccaugugagagcaacggagauaaggguucgggcgggaucaaaggaggcuuuguacaucaaaggauggcaucuaagauuggucggugguacucccguacaaugucaaaaacugaacgcauggggaugggccucuauguuaaguacgacggagaccccugggcugauagugacgcccuugcucugagcggcgugauggucuccauggaggaaccggggugguacucuuucggauuugagaucaaggauaaaaagugcgacgugccuuguauagguauugaaauggugcacgauggcgggaaagagaccuggcauagcgccgcaacagccaucuauugcuugaugggaucaggccagcuacugugggacacugucaccgguguugauauggcucucuga

SEQ ID NO: 150636 - RNA, 1401 nt, Artificial Sequence
  derived and/or modified sequence opt3 from neuraminidase__InfluenzaB__ABL76544
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagagcguaacaaacugagacaucuaaucagcgugaagcucggcaagauaccgacugucgaaaauuccaucuuccacauggcugccuggucaggcagugcgugccaugacgggaaagaauggaccuauauuggaguggauggucccgacaacaaugcacugcuuaagaucaaauacggcgaggccuacacagauacuuaucacagcuacgcuaacaauauucugaggacccaggaaucugccuguaacugcaucgggggaaauuguuauuugaugauaacagacggcuccgcaucagguguuagcgagugccgguuucucaagauucgcgaggggagaaucauuaaagaaaucuucccuaccggaagggugaagcacacggaggaauguacuugcggcuuugcuaguaacaagacaaucgagugugccugccgggauaauucuuacaccgcgaaacgcccauucgucaagcugaacguggaaacugacacagccgagauucgauuaaugugcaccgagacguaucuggauacccccagaccugacgauggcuccauaacagggccaugugaaagcaacggagacaaagguucgggcgggaucaagggaggcuuuguacaucaaaggauggcaucuaaaauuggucggugguacucccguacuaugucaaagaccgagcgcauggggaugggccucuauguuaaauacgauggagaccccugggcugacagugaugcccuugcucugagcggcgugauggucuccauggaggagccggggugguacucuuucggauuugaaaucaaggacaagaaaugcgaugugccuuguauagguauugagauggugcacgacggcgggaaggagacauggcauagcgccgcaacugccaucuauugcuugaugggaucaggccagcuacugugggauaccgucacagguguugacauggcucucuga

SEQ ID NO: 150637 - RNA, 1401 nt, Artificial Sequence; identical to SEQ ID NO: 150635
  derived and/or modified sequence opt3 from neuraminidase__InfluenzaB__ABL76566

SEQ ID NO: 150638 - RNA, 1401 nt, Artificial Sequence
  derived and/or modified sequence opt3 from neuraminidase__InfluenzaB__ABL76588
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauuaugcaaacgccucgaauguucaagcggugaacagaucagcuaccaaaggaguaacacuccugcugcccgaaccugaguggaccuacccaaggcucagcugccccgguaguacuuuccagaaggccuuacugaucuccccucaccgguuuggcgaaacaaaaggaaauucugcaccacuuauuauccgcgagcccuucauugccugugggccuaacgaaugcaagcauuuugcuuugacccacuaugcagcccagccaggcgguuacuauaaugggacgcgaggagaccguaacaaacugagacaucuaaucagcgugaagcucggcaagauaccgacugucgaaaauuccaucuuccacauggcugccuggucaggcagugcgugucaugaugggaaagaguggaccuacauuggaguggacggucccgauaacaaugcacugcuuaagaucaaauacggcgaggccuauacagacacuuaccacagcuaugcuaacaauauucugaggacccaggagucugccugcaacuguaucgggggaaauugcuacuugaugauaacagauggcuccgcaucagguguuagcgaaugucgguuucucaagauucgcgaggggagaaucauuaaagagaucuucccuaccggaagggugaagcacacggaagagugcacuuguggcuuugcuaguaacaagacaaucgaaugcgccugucgggacaauucuuauaccgcgaaacgcccauucgucaagcugaacguggagacugauacagccgaaauucgauuaaugugcaccgagacguaccuggacacccccagaccugaugacggcuccauaacagggccaugcgagagcaacggagauaaagguucgggcgggaucaagggaggcuuuguacaucaaaggauggcaucuaaaauuggucggugguauucccguacuaugucaaagaccgaacgcauggggaugggccucuacguuaaauacgacggagaccccugggcugauagugacgcccuugcucugagcggcgugauggucuccauggaggaaccggggugguauucuuucggauuugagaucaaggauaagaaaugugacgugccuugcauagguauugaaauggugcacgauggcgggaaggagacauggcauagcgccgcaacugccaucuacuguuugaugggaucaggccagcuacugugggacaccgucacagguguugauauggcucucuga

SEQ ID NO: 150639 - RNA, 1401 nt, Artificial Sequence; identical to SEQ ID NO: 150634
  derived and/or modified sequence opt3 from neuraminidase__InfluenzaB__ABL76599

SEQ ID NO: 150640 - RNA, 1401 nt, Artificial Sequence; identical to SEQ ID NO: 150634
  derived and/or modified sequence opt3 from neuraminidase__InfluenzaB__ABL76610

SEQ ID NO: 150641 - RNA, 1401 nt, Artificial Sequence
  derived and/or modified sequence opt3 from neuraminidase__InfluenzaB__ABL76621
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgagacguaucuggacacccccagaccugaugacggcuccauaacagggccaugugagagcaacggagaaaaggguucgggcgggaucaaaggaggcuuuguacaucaaaggauggcaucuaagauuggucggugguacucccguacuaugucaaaaaccaagcgcauggggaugggccucuauguuaaguacgauggagaccccugggcugacagugaugcccuugcucugagcggcgugauggucuccauggaggaaccggggugguacucuuucggauuugagaucaaagacaagaaaugcgauauaccuuguauugguaucgaaauggugcacgacggcgggaaggagacauggcauagcgccgcaacugccaucuauugcuugaugggaucaggccagcuacugugggauaccgugacaggugucgacauggcucucuga

SEQ ID NO: 150642 - RNA, 1401 nt, Artificial Sequence
  derived and/or modified sequence opt3 from neuraminidase__InfluenzaB__ABL76632
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaaaugagacaucugauaagcgugaagcuaggaaagaucccaacugucgagaacuccauuuuccacauggcugccuggucaggcagugcgugccaugauggcaaagaauggaccuauaucgggguggacggaccggauagcaaugcacuccugaagauuaaauacggugaggccuacacagacacuuaucacucuuacgcuaagaacauccuuaggacccaagaauccgccuguaauugcauaggcggggauuguuaucugaugauuacagacggacccgcaucaggcaucagcgagugccgguuuuugaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacucaacgucgaaacugacacagccgagauccgacugaugugcaccgagacguauuuagauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcuguauguaaaguacgacggcgaucccuggacagacagugaggcucucgcccuuagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaguguauugccugauggggucaggacaguugcuaugggacaccgucacuggcguugauauggcccuguga

SEQ ID NO: 150643 - RNA, 1401 nt, Artificial Sequence
  derived and/or modified sequence opt3 from neuraminidase__InfluenzaB__ABL76643
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcucuauguaaaguacgacggcgaucccuggacagacagugaggcucuugcccugagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaauuuauugcuugauggggucaggacagcuacugugggacaccgugacuggcgucgauauggcccucuga

SEQ ID NO: 150644 - RNA, 1401 nt, Artificial Sequence
  derived and/or modified sequence opt3 from neuraminidase__InfluenzaB__ABL76654
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucaacuaccaaaggaguaacacuccugcugccggaacccgaguggaccuauccuaggcucagcuguccagguaguacuuuccagaaggcuuuacugauuucuccccaccgguuuggcgaaacaaaaggaaauuccgccccucuuaucauucgcgagccauucaucgcaugcgggcccaccgaauguaagcauuuugccuugacgcacuacgcugcacagccuggcgguuauuacaacgggacucgagaggaccguaauaaacugagacaucuaauaagcgugaagcucggaaagaucccaaccgucgagaacuccauuuuccacauggccgcuuggucaggcagugccugccaugauggcaaagaauggacauauaucgggguggacggaccggauagcaaugcgcugcuuaagauuaaauacggugaggcauacacugacaccuaucacucuuacgccaagaacauccugaggacacaagaauccgcuuguaauugcauaggcggggauuguuauuugaugauuaccgacggacccgccucaggcaucagcgagugccgguuucucaaaauucgcgaggguagaaucaucaaggaaauuuucccuacggggaggguuaagcacacugaggaauguacaugcggauuugcaaguaacaaaaccauagagugugcuugccgggauaauucuuacacugccaagcgcccauucgugaaacugaacgucgaaacagacaccgcggagauccgauuaaugugcacggagaccuaucuggauacacccagaccuaaugacggcuccauuacuggcccaugugaaagcgauggggacaagggaucggguggcaucaaagggggauuugugcaucagaggauggccucuaagauaggccggugguacucccguaccaugucaaaaacaaagcgcauggguauggggcucuauguaaaguacgacggcgaucccuggacugacagugaggcacuugcucugagcggaguuaugguguccauggaggaaccgggcugguacucuuucggguuugaaauuaaagauaagaaaugcgacgucccuuguaucggaaucgagauggugcacgaugguggcaagaccacauggcauagcgccgcuaccgccauuuauugcuugauggggucaggacagcuacugugggacacugugacgggcgucgauauggcacucuga

SEQ ID NO: 150645 - RNA, 1401 nt, Artificial Sequence
  derived and/or modified sequence opt3 from neuraminidase__InfluenzaB__ABL76665
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaauuugauggggacaagggaagcgguggcaucaaagggggauucgugcaucagaggauggcaucgaagauaggccggugguacucucguacuauguccaaaaccaagcgcauggguauggggcucuauguaaaguacgacggcgaucccuggacagacucagaggcucuugcccugaguggaguuauggugagcauggaggaaccgggcugguacuccuuuggguucgaaauuaaagauaagaaaugcgacgucccuuguaucggaaucgagauggugcacgaugguggcaagacuaccuggcauucugcugccacagcaauuuauugcuugauggggagcggacagcuacugugggacaccgugacuggcgucgauauggcccucuga

SEQ ID NO: 150646 - RNA, 1401 nt, Artificial Sequence
  derived and/or modified sequence opt3 from neuraminidase__InfluenzaB__ABL76676
augcugcccagcaccauccagacacucacucuuuuccugacguccggcgggguguuguuaucucuguacgucucagccagucuaagcuaucuccuguacuccgacauucuucugaaguuuucucaaaccggaauaacagcuccuaucaugccauuggauugcgcaaacgccucgaauguucaggcggugaacagaucagcuacuaaagguguaacccuccugcugccggagcccgaauggacauauccuaggcucagcuguccaggcaguaccuuccagaaggccuuacugauuucuccccaccgguuuggggagacuaaaggaaauuccgcaccucuuaucauucgcgaaccauucaucgccugcggccccaaggaguguaaacauuuugcuuugacacacuacgcagcccagccugguggguauuacaacggaacccgagaagaccguaauaagcugagacaucuaauaagcgugaagcucggcaaaaucccaacggucgagaacuccauuuuccacauggcugccuggucaggcagugcgugccaugaugggagggaguggacuuauaucggaguggacgguccggauagcaaugcacugcuuaagauuaaauacggcgaagccuacaccgacacauaucacucuuacgcuaagaacauccugcggacucaagaguccgccuguaauugcauagggggagauuguuauuugaugauuaccgacggccccgcaucagguaucagcgaaugccgcuuucucaaaauuagagaggggaggaucaucaaggagauuuucccuacaggacggguuaagcacaccgaagaguguacgugcggcuuugcuaguaacaaaacuauagaaugugccugccgcgauaauucuuacacagcgaagcgaccauucgugaaacugaacgucgagaccgacacugccgaaaucagauuaaugugcacagagaccuaucuggauacgcccaggccuaaugacggcuccauuaccgggccaugugagagcaacggagauaaggguucgggcgggaucaaaggaggcuuugugcaucagcggauggcaucuaagauaggucguugguacucccgcacaaugucaaaaacuaagagaauggggaugggccucuauguaaaguacgacggagaccccuggaccgauagugaagcucuugcccugagcggcguuaugguguccauggaggaaccggggugguacucuuucggauuugagauuaaagacaagaaaugcgaugucccuuguaucgguaucgaaauggugcacgacggcgggaagacaacuuggcauagcgcugccaccgcaauuuauugcuugaugggaucaggccagcuacugugggauacagugaccggugucgacauggcccucuga

SEQ ID NO: 150647 - RNA, 1401 nt, Artificial Sequence
  derived and/or modified sequence opt3 from neuraminidase__InfluenzaB__ABL76687
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaauuugauggggacaagggaagcgguggcaucaaagggggauucgugcaucagaggauggcaucgaagauaggccggugguacucucguacuauguccaaaaccaagcgcauggguauggggcucuauguaaaguacgacggcgaucccuggacagacucagaggcucuugcccugaguggaguuauggugccgauggaggaaccuggcugguacagcuuuggguucgaaauuaaagauaagaaaugcgacguccccuguaucggaaucgagauggugcacgaugguggcaagacuaccuggcauuccgcugccacagcaauuuauugcuugauggggucuggacagcuacugugggacaccgugacuggcgucgauauggcccucuga

SEQ ID NO: 150648 - RNA, 1401 nt, Artificial Sequence
  derived and/or modified sequence opt3 from neuraminidase__InfluenzaB__ABL76698
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaaugacacuccugcugcccgaaccugaguggaccuauccaaggcucagcugucccgguaguacuuuccagaaggccuuacugaucuccccucaccgguuuggcgaaacacgcggaaauucugcaccacuuaccauucgagagcccuucaucgccugcgggccuaaagaauguaagcauuuugcuuugacgcacuacgcagcccagccaggcgguuauuacaacgggacucgugaggacagaaauaaacugaggcaucuaauuagcguaaagcucggaaagaucccgaccguggagaacuccauauuccacauggcugccuggucaggcagugcgugccaugauggccgggaauggacauauaucggggucgacggacccgauagcaaugcacugauuaaaaucaaguacggugaggccuacacugacaccuaucacucuuacgcuaacaauauucuucgcacacaggaauccgccuguaacugcaucggcggggauuguuaucugaugauaaccgacggaucagcaagcggcauuaguaaaugcagauuuuugaagaucagggagggucggauuaucaaagagaucuucccuacggggcgcguggaacacacugaggaauguacaugcggauuugcuucuaauaagaccauugagugugccugccgagauaacuccuacacugcgaagagaccauucguuaaacucaauguggaaacagacaccgccgagauaaggcugaugugcacggagaccuauuuagauacaccccggccugacgauggcagcaucacuggcccaugugaaucgaacggggacaagggacgugguggcauuaaagggggauuuguccaucaacgcauggcaucuaagaucggcagaugguacuccaggaccaugucaaaaacagagcggauggguauggaacuguaugugaaguacgacggggaucccuggacugacagugaggcucucgccccgagcggcguaaugguuuccauggaggaaccuggaugguacucuuucggcuuugagauaaaagauaagaagugcgacgugcccuguauugggaucgaaaugguccacgauggagguaaaaagaccuggcauagcgcugccacagcaaucuauugccuuaugggcucagggcagcuguugugggacaccgugacuggaguggauauggcccuauga

SEQ ID NO: 150649 - RNA, 1401 nt, Artificial Sequence
  derived and/or modified sequence opt3 from neuraminidase__InfluenzaB__ABL76720
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacaaggguucgggcgggaucaaaggaggcuuuguacaucaaaggauggcaucuaagauuggucggugguacucccguacuaugucaaaaaccgagcgcauggggaugggccucuauguuaaguacgacggagaucccugggcugacagugaugcccuugcuuucagcggcgugauggucuccaugaaggaaccggggugguacucuuuuggauucgagaucaaagacaagaaaugcgaugugccuuguauagguauugaaauggugcacgacggcgggaaggagacauggagaagcgccgcaacugccaucuauugccugaugggaucaggccaguugcuaugggauaccgucacagguguugacauggcucuguga

SEQ ID NO: 150650 - RNA, 1401 nt, Artificial Sequence
  derived and/or modified sequence opt3 from neuraminidase__InfluenzaB__ABL76731
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuaucacccauuacgcagcccagccaggcgguuauuacaaugggacgcgaggagaccguaacaaauugagacaccugauaagcgugaagcuaggcaagaucccgacugucgaaaauuccauuuuccauauggcugccuggucaggcagugcgugccacgaugggaaagaguggaccuauaucggaguggacggucccgauaacaaugcacuccugaagauuaaauacggcgaggccuacacagacacuuaucacagcuacgcuaacaauauccuuaggacccaggagucugccuguaacugcauagggggaaauuguuaucugaugauuacagauggcuccgcaucagguguuagcgaaugccgguuuuugaagauccgcgaggggagaauuaucaaagagaucuucccuaccggaagggugaagcauacggaagaguguacuugcggcuuugcuaguaacaagacaauugaaugugccugccgggacaauucuuacaccgcgaaacgcccauucgucaagcucaacguggagacugauacagccgaaauacgacugaugugcaccgacacguauuuagauacccccagaccugacgauggcuccaucacagggccaugugagagcaacggagacaaagguucgggcgggauuaagggaggcuuuguacaccagaggauggcaucuaaaaucggucggugguacucccguacuaugucaaagaccgagcgcauggggaugggccuguauguuaaauacgacggagaucccugggcugacagugaugcccucgcuuucagcggcgugauggucuccaugaaggaaccggggugguacucuuuuggauucgagauaaaggacaaaaagugcgaugugccuuguauugguaucgaaauggugcaugacggcgggaaagagacauggcacagcgccgcaacugccaucuauugccuuaugggaucaggccaacuguugugggauaccgucacagguguugacauggcucuauga

SEQ ID NO: 150651 - RNA, 1401 nt, Artificial Sequence
  derived and/or modified sequence opt3 from neuraminidase__InfluenzaB__ABL76742
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacaaggguucgggcgggaucaaaggaggcuuuguacaucaaaggauggcaucuaagauuggucggugguacucccguacuaugucaaaaaccgagcgcauggggaugggccucuauguuaaguacgacggagaucccugggcugacagugaugcccuugcuuucagcggcgugauggucuccaugaaggaaccggggugguacucuuuuggauucgagaucaaagacaagaaaugcgaugugccuuguauagguauugaaauggugcacgacggcgggaaggagacauggcauagcgccgcaacugccaucuauugccugaugggaucaggccaguugcuaugggauaccgucacagguguugacauggcucuguga

SEQ ID NO: 150652 - RNA, 1401 nt, Artificial Sequence
  derived and/or modified sequence opt3 from neuraminidase__InfluenzaB__ABL76753
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuacaggaaauuccgcaccucuuaucauucgcgagccauucaucgccugcgggcccaaagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcagggaauggaccuauaucgggguggacggaccggauaauaacgcacugcuuaaaauuaaguacggugaggccuacacagacacuuaucacagcuacgcuaaaaauauccugcggacccaagaaucugccuguaacugcauaggcggggauuguuauuugaugauuacagacggacccgcauccggcaucucagagugccgcuuucucaagauuagagaggguaggaucaucaaagaaauuuucccuaccgggcggguuaagcacacggaggaauguacuugcggauuugcuagcaauaagacaauagagugugccugccgcgauaacaguuacaccgcgaaacgaccauucgugaagcugaaugucgaaacugacacagccgagaucagauuaaugugcaccgagacguaucuggauacccccaggccuaacgacggcucuauuacaggcccaugugaauccaauggggauaaaggaagcgguggcaucaaagggggauuugugcaucagcggauggcaucgaagauaggccguugguacucucgcacuauguccaagaccaaaagaauggguauggggcucuauguaaaguacgacggcgaccccuggacagauucagaggcucuugcccugaguggaguuauggugagcauggaggaaccgggcugguacuccuucggguuugaaauuaaggacaaaaagugcgaugucccuuguaucggaaucgagauggugcacgacgguggcaaaacuaccuggcauucugcugccacagcaauuuauugcuugauggggagcggacagcuacugugggauaccgugacuggcgucgacauggcccucuga

SEQ ID NO: 150653 - RNA, 1401 nt, Artificial Sequence; identical to SEQ ID NO: 150622
  derived and/or modified sequence opt3 from neuraminidase__InfluenzaB__ABL76764

SEQ ID NO: 150654 - RNA, 1401 nt, Artificial Sequence; identical to SEQ ID NO: 150622
  derived and/or modified sequence opt3 from neuraminidase__InfluenzaB__ABL76775

SEQ ID NO: 150655 - RNA, 1401 nt, Artificial Sequence
  derived and/or modified sequence opt3 from neuraminidase__InfluenzaB__ABL76797
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguugagcacacggaagaguguacuugcggauuugcuucuaacaagacaauugaaugugccugccgggacaauuccuacaccgcgaaacgcccauucgugaagcugaacgucgagacugauacagccgagauacgauuaaugugcaccgaaacguaucuggacacccccagaccugaugacggcagcaucacaggcccaugugagucgaauggggauaaaggaucugguggcauuaaagggggauuugugcaucaaaggauggcauccaagaucggccggugguacucacguacuaugaguaagaccaaacgcauggguauggggcucuauguaaaguacgacggcgaccccuggacagauagcgacgcucuugcccuguccggaguuauggugucuauggaggaaccgggcugguacagcuucggguuugaaauaaaggauaaaaagugcgacgucccuuguauuggaaucgagauggugcacgaugguggcaaagagacuuggcauucagcugccaccgcaaucuauugcuugauggggaguggacagcuacugugggacacagugaccggcgucaacauggcccucuga

SEQ ID NO: 150656 - RNA, 1401 nt, Artificial Sequence
  derived and/or modified sequence opt3 from neuraminidase__InfluenzaB__ABL76819
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguuaagcacacggaggaauguacuugcggauuugcuucuaacaaaacaauugagugugccugccgggacaauuccuacaccgcgaagcgcccauucgugaaacugaacgucgaaacugauacagccgagauacgauuaaugugcaccgagacguaucuggacacccccagaccugaugacggcagcaucacaggcccaugugaaucgaauggggauaagggaucugguggcauuaaagggggauuugugcaucaaaggauggcauccaagaucggccggugguacucacguacuaugaguaaaaccaagcgcauggguauggggcucuauguaaaguacgacggcgaccccuggacagauagcgacgcucuugcccuguccggaguuauggugucuauggaggaaccgggcugguacagcuucggguuugagauaaaagauaagaaaugcgacgucccuuguauuggaaucgaaauggugcacgaugguggcaaggagacuuggcauucagcugccaccgcaaucuauugcuugauggggaguggacagcuacugugggacacagugaccggcgucgauauggcccucuga

SEQ ID NO: 150657 - RNA, 1401 nt, Artificial Sequence
  derived and/or modified sequence opt3 from neuraminidase__InfluenzaB__ABL76830
augcugcccagcaccauccagacacucacucuuuuccugacguccggcgggguguuguuaucucuguacgucucagccagucuaagcuaucuccuguacuccgacauucuucugaaguuuucuccuaccaaaauaacagcuccaacuaugccguuggauugcgcaaacgccucgaauguucaagcggugaacagaucagcuaccaagggaguaacacuccugcugcccgagccugaauggaccuauccaaggcucagcugucccgguaguacuuuccagaaagccuuacugaucuccccucaccgguuuggcgagacaaagggaaauucugcaccacuuauuauccgcgaacccuucauugccugcgggccuaaagaguguaagcauuuugcuuugacccacuacgcagcccagccaggcgguuauuacaacgggacgcgaggagaccguaauaagcugagacaucuaaucagcgugaaacucggcaagauaccgacugucgaaaacuccaucuuccacauggcugccuggucaggcagugcgugccaugaugggaaagaguggaccuauauuggaguggacggucccgauaauaacgcacugcuuaagaucaaauacggcgaggccuacacagacacuuaucacagcuacgcuaauaacauucugaggacccaggaaucugccuguaauugcaucgggggaaacuguuauuugaugauaacagauggcuccgcaucagguguuagcgagugccgguuucucaagauucgcgaagggagaaucauuaaggagaucuucccuaccggaagggugaaacacacggaggaauguacuugcggcuuugcuaguaauaagacaaucgagugugccugccgggacaacucuuacaccgcgaaacgcccauucgucaagcugaauguggaaacugauacagccgagauucgauuaaugugcaccaaaacguaucuggacacccccagaccugaugacggcuccauaacagggccaugugaaagcaacggagauaaggguucgggcgggaucaaaggaggcuuuguacaucaaaggauggcaucuaagauuggucggugguacucccguacuaugucaaagaccaaacgcauggggaugggccucuauguuaaguacgacggagaccccugggcugauagugacgcccuugcucugagcggcgugauggucuccauggaggagccggggugguacucuuucggauuugaaaucaaagauaagaaaugcgacgugccuuguauagguauugagauggugcacgauggcgggaaggaaacauggcauagcgccgcaacugccaucuauugcuugaugggaucaggccagcuacugugggacaccgucacagguguugauauggcucucuga

SEQ ID NO: 150658 - RNA, 1401 nt, Artificial Sequence
  derived and/or modified sequence opt3 from neuraminidase__InfluenzaB__ABL76852
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguuaagcacacggaggaauguacuugcggauuugcuucuaacaaaacaauugagugugccugccgggacaauuccuacaccgcgaagcgcccauucgugaaacugaacgucgaaacugauacagccgagauacgauuaaugugcaccgagacguaucuggacacccccagaccugaugacggcagcaucacaggcccaugugaaucgaauggggauaagggaucugguggcauuaaagggggauuugugcaucaaaggauggaguccaagaucggccggugguacucacguacuaugaguaaaaccaagcgcauggguauggggcucuauguaaaguacgacggcgaccccuggacagauagcgacgcacuugcucuguccggaguuauggugucuauagaggaaccgggcugguacagcuucggguuugaaauuaaagauaagaaaugcgacgucccuuguaucggaaucgagauggugcacgaugguggcaaggagacuuggcauucagccgcuaccgccauuuauugcuugauggggaguggacagcuacugugggacacagugaccggcgucgauauggcacucuga

SEQ ID NO: 150659 - RNA, 1401 nt, Artificial Sequence
  derived and/or modified sequence opt3 from neuraminidase__InfluenzaB__ABL76863
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguuaagcacacggaggaauguacuugcggauuugcuucuaacaaaacaauugagugugccugccgggacaauuccuacaccgcgaagcgcccauucgugaaacugaacgucgaaacugauacagccgagauacgauuaaugugcaccgagacguaucuggacacccccagaccugaugacggcagcaucacaggcccaugugaaucgaauggggauaagggaucugguggcauuaaagggggauuugugcaucaaaggauggcauccaagaucggccggugguacucacguacuaugaguaaaaccaagcgcauggguauggggcucuauguaaaguacgacggcgaccccuggacagauagcgacgcucuugcccuguccggaguuauggugucuauggaggaaccgggcugguacagcuucggguuugagauaaaagauaagaaaugcgacgucccuuguauuggaaucgaaauggugcacgaugguggcaaggagacuuggcauucagcugccaccgcaaucuauugcuugauggggaguggacagcuacugugggacacagugaccggcgucgauauggccauguga

SEQ ID NO: 150660 - RNA, 1401 nt, Artificial Sequence
  derived and/or modified sequence opt3 from neuraminidase__InfluenzaB__ABL76874
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacucaagcgcuaccaaaggaguaacacuccugcugcccgaaccugaguggaccuauccaagacucaguugucccgguuccacuuuccagaaggccuuacugaucucuccucacagguuuggcgaaacaaaagggaauagcgcaccacuuauuauccgggagcccuucauugccugcggaccuaaggaauguaaacauuuugcuuugacccacuacgcagcccagccaggcgguuauuacaacgggacgcgcggagaccgaaauaagcugcgucaucuaaucuccgugaagcucggcaaaauaccgacugucgagaacucaaucuuccacauggcugccuggaguggcagcgcgugccaugaugggaaggaguggaccuauauuggaguggacggucccgauucuaaugcacugcuuaaaaucaaguacggcgaagccuacacagacacuuaucacuccuacgcuaacaauauucugagaacccaggagucagccuguaacugcaucgggggaaauuguuauuugaugauaacagauggcagcgcaagugguauuucugaaugcagguuucucaaaauccgggaggggcgcauuaucaaggagaucuucccuaccggaagaguuaagcacacggaagaguguacuugcggcuuugcuuccaacaaaacaauugaaugugccugcagggacaauagcuacaccgcgaagcggccauucgugaaacugaacgucgagacugauacagccgaaauaaaguuaaugugcaccgagacguaucuggacacaccccgcccugaugacggcucgaucaccgggccaugugagucuaauggagauaaagguuccggcgggauuaagggaggcuuugugcaucaacgaauggcaucaaaaaucgguagaugguacaguaggacuaugagcaagaccaagcggauggggaugggccucuauguaaaauacgacggagaccccuggacagauuccgacgcucuugcccugucuggcguuauggugagcauggaggaaccggggugguacucauucggauuugaaauaaaggauaaaaagugcgacgucccuuguauugguaucgagauggugcacgauggcgggaaagaaacuuggcauagugcugccaccgcaaucuauugcuugaugggauccggccagcuacugugggacacagugaccggugucgauauggcccucuga

SEQ ID NO: 150661 - RNA, 1401 nt, Artificial Sequence
  derived and/or modified sequence opt3 from neuraminidase__InfluenzaB__ABL76885
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauuaugcaaacgccucgaauguucaggcggugaacagaucagcuaccaaaggaguaacacuccugcugccggaacccgaguggaccuacccuaggcucagcugcccagguaguacuuuccagaaggccuuacugaucucuccccaccgguuuggcgaaacaaaaggaaauuccgcaccucuuauuauccgcgagccauucauugccugugggcccaaggaaugcaaacauuuugcuuugacccacuaugcagcccagccuggcgguuacuauaacgggacgcgagaggaccguaauaagcugagacaucuaaucagcgugaagcucggaaaaauaccaacugucgagaacuccaucuuccacauggcugccuggucaggcagugcgugucaugauggcagggaauggaccuacauugggguggacggaccggauagcaaugcacugcuuaagaucaaauacggugaggccuauacagacacuuaccacucuuaugcuaagaacauucugcggacccaagaauccgccugcaauuguaucggcggggauugcuacuugaugauaacagacggaucagcaagcggcauuagugagugucgcuuucucaaaaucagagaggguaggauuaucaaggaaaucuuccccaccgggcggguuaagcacacggaggaaugcacuuguggauuugcuucuaacaaaacaauugagugcgccugucgcgauaauuccuauaccgcgaagcgaccuuucgugaaacugaacgucgaaacugacacagccgagauaagauuaaugugcaccgagacguaccuggauaccccaaggcccgacgauggcagcaucacaggcccuugcgaaucgaauggggacaagggaucugguggcauuaaagggggauuugugcaucagcggauggcauccaagaucggccguugguauucacgcacuaugaguaaaaccaagagaauggguauggggcucuacguaaaguacgacggcgauccauggacagacagcgaggcucuugcccuguccggaguuauggugucuauggaggaacccggcugguauagcuucggguuugaaauaaaagauaagaaaugugacgucccgugcauuggaaucgagauggugcacgaugguggcaagacuaccuggcauucagcugccacagcaaucuacuguuugauggggaguggacagcuacugugggacaccgugacuggcgucgauauggcccucuga

SEQ ID NO: 150662 - RNA, 1401 nt, Artificial Sequence
  derived and/or modified sequence opt3 from neuraminidase__InfluenzaB__ABL76896
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggauguauccuaggcucagcuguccagguaguaccuuccagaaggccuuacugaucucuccccaccgguuuggcgaaacuaaaggaaauuccgcaccucuuauuauccgcgagccauucauugccugcgggcccaaggaauguaaacauuuugcuuugacacacuacgcagcccagccuggcgguuauuacaacgggacccgagaggaccguaauaagcugagacaucuaaucagcgugaagcucggaaaaauaccaacggucgagaacuccaucuuccacauggcugccuggucaggcagugcgugccaugauggcagggaauggacuuauauugggguggacggaccggauagcaaugcacugcuuaagaucaaauacggugaggccuacaccgacacauaucacucuuacgcuaagaacauucugcggacucaagaauccgccuguaauugcaucggcggggauuguuauuugaugauaaccgacggaucagcaagcggcauuagugagugccgcuuucucaaaaucagagaggguaggauuaucaaggaaaucuuccccacagggcggguuaagcacaccgaggaauguacgugcggauuugcuucuaacaaaacuauugagugugccugccgcgauaauuccuacacagcgaagcgaccuuucgugaaacugaacgucgaaaccgacacugccgagauaagauuaaugugcacagagaccuaucuggauacgccaaggcccgacgauggcagcaucaccggcccuugugaaucgaauggggacaagggaucugguggcauuaaagggggauuugugcaucagcggauggcauccaagaucggccguugguacucacgcacaaugaguaaaacuaagagaauggguauggggcucuauguaaaguacgacggcgauccauggaccgacagcgaggcucuugcccuguccggaguuauggugucuauggaggaacccggcugguacagcuucggguuugaaauaaaagauaagaaaugcgacgucccguguauuggaaucgagauggugcacgaugguggcaagacaacuuggcauucagcugccaccgcaaucuauugcuugauggggaguggacagcuacugugggacgccgugacaggcgucgauauggcucucuga

SEQ ID NO: 150663 - RNA, 1401 nt, Artificial Sequence
  derived and/or modified sequence opt3 from neuraminidase__InfluenzaB__ABL76918
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgagacguaucuggacacccccagaccugaugacggcuccauaacagggccaugugagagcaacggagauaaagguucgggcgggaucaagggaggcuuuguacaucaaaggauggcaucuaaaauuggucggugguacucccguacuaugucaaagaccgaacgcauggggaugggccucuauguuaaauacgacggagaccccugggcugauagugacgcccuugcucugaucggcgugauggucagcauggaggaaccggggugguacuccuucggauuugagauaaaggauaagaaaugcgacgugccuuguauugguaucgaaauggugcacgauggcgggaaggagacauggcauucugccgcaacugccaucuauugcuugaugggaagcggccagcuacugugggacaccgucacagguguuaauauggcucucuga

SEQ ID NO: 150664 - RNA, 1401 nt, Artificial Sequence
  derived and/or modified sequence opt3 from neuraminidase__InfluenzaB__ABL76962
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaaugucucucgauugcgcaaacgccucgaauguucaagcggugaaccacucagcuacugaggaaaugaccuuccugcugccggagcccgaauggacauauccuagacucagcugucagggaaguaccuuucagaaggccuuacugauuuccccacauagguucggugaggcaaaaggcaauucugcuccccuuaucauucgggaaccuuuuaucgcuugcgggccaaaggaguguaaacacuucgcauugacucauuacgccgcucagcccggaggcuauuacaacgguacacgcgaggaccgaaauaagcugcgucaccuaauaagcguaaaccucgggaagaucccuaccguggaaaauuccauuuuucauauggccgcguggucaggaagugcaugccacgauggcagagaguggacguauaucggcgucgacgggccagauagcaacgcccugauuaaaaucaaguacggagaagccuacacugacaccuaucacucuuacgccaauaacauacuuaggacacaagaguccgcauguaauugcauugguggcgauuguuaucugaugaucacugacgggucagcuagcggaauuaguaaaugccgguucuugaagauccgcgagggcagaaucauuaaagaaauauuuccgaccgguaggguggagcauacagaagaguguaccugcggguucgccucuaacaagacgaucgaaugugcgugccgggauaauuccuacacugccaagcgccccuuuguuaaacucaacguggagacagacaccgcagagauucgacugaugugcacugaaacauauuuagauaccccuagaccagacgauggaagcaucacgggccccugugagucgaauggcgacaaggggucuggagguauaaaaggcggguucguccaccagaggauggcuuccaagauuggacggugguacucacguaccaugaguaaaacaaagcgcaugggcauggaacuguaugugaaauacgacggugauccuuggacugacagcgaugcccucgcuccauccgggguaaugguuucuauggaggaacccggcugguacagcuuuggauucgagaucaaggacaagaaaugcgaugugccguguaucggcauugagaugguccaugacgggggaaagaaaaccuggcacucagccgcaacagccaucuauugccuuauggguaguggccagcuguugugggauacugugaccgggguggacauggcucuauga

SEQ ID NO: 150665 - RNA, 1401 nt, Artificial Sequence; identical to SEQ ID NO: 150595
  derived and/or modified sequence opt3 from neuraminidase__InfluenzaB__ABL76973

SEQ ID NO: 150666 - RNA, 1401 nt, Artificial Sequence
  derived and/or modified sequence opt3 from neuraminidase__InfluenzaB__ABL76984
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaaccucucagcuaccaaaggaguaacacugcugcucccggaacccgaguggaccuauccuagauuaagcuguccagguaguacuuuccagaaggcccugcuuaucucuccccacagguuuggcgaaacaaaaggaaauuccgcaccuuugauuauccgggagccauucauugccugcgggcccaaggaauguaaacauuuugcucugacccacuacgcagcccagccuggcgguuauuacaacgggacgcgcgaggaccgaaauaagcuacgucaucucaucagcgugaagcugggaaaaauaccaacugucgagaacuccaucuuccacauggcugccuggucaggcagugcgugccaugauggcagagaauggaccuauauugggguggacggaccggauagcaaugcacuucugaagaucaaauacggugaggccuacacagacacuuaucacucuuacgcuaacaauauuuugaggacccaagaauccgccuguaacugcaucggcgggaauuguuaucucaugauaacagauggaucagcaagcggcauuagugagugccgguuucugaagauccgcgaggguagaauuaucaaagaaaucuuccccaccgggaggguugagcacacggaagaguguacuugcggauuugcuucuaacaagacaauugaaugugccugccgggacaauuccuacaccgcgaagcgcccuuucgugaaauuaaacgucgagacugauacagccgagauacgacugaugugcaccgaaacguaucucgacaccccaagacccgaugacggcagcaucacaggcccuugugagucgaauggggauaagggaucugguggcauuaaagggggauuugugcaucagaggauggcauccaagaucggccggugguacucacguacuaugaguaaaaccaagcgcauggguauggggcuuuauguaaaauacgacggcgacccauggacagauagcgacgcucuggccuuguccggaguuauggugucuauggaggaacccggcugguacagcuucggguuugaaauaaaggauaagaaaugcgacgucccguguauuggaaucgagauggugcacgaugguggcaagagaacuuggcauucagcugccaccgcaaucuauugccuaauggggaguggacagcugcucugggacacagugaccggcgucgauauggcccuguga

SEQ ID NO: 150667 - RNA, 1401 nt, Artificial Sequence; identical to SEQ ID NO: 150622
  derived and/or modified sequence opt3 from neuraminidase__InfluenzaB__ABL77006

SEQ ID NO: 150668 - RNA, 1401 nt, Artificial Sequence; identical to SEQ ID NO: 150666
  derived and/or modified sequence opt3 from neuraminidase__InfluenzaB__ABL77017

SEQ ID NO: 150669 - RNA, 1401 nt, Artificial Sequence
  derived and/or modified sequence opt3 from neuraminidase__InfluenzaB__ABL77028
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguugagcacacggaagaguguacuugcggauuugcuucuaacaagacaauugaaugugccugccgggacaauuccuacaccgcgaaacgcccauucgugaagcugaacgucgagacugauacagccgagauacgauuaaugugcaccgaaacguaucuggacacccccagaccugaugacggcagcaucacaggcccaugugagucgaauggggauaaaggaucugguggcauuaaagggggauuugugcaucaaaggauggcauccaagaucggccggugguacucacguacuaugaguaagaccaaacgcauggguauggggcucuauguaaaguacgacggcgaccccuggacagauagcgacgcucuugcccuguccggaguuauggugucuauggaggaaccgggcugguacagcuucggguuugaaauaaaggauaaaaagugcgacgucccuuguauuggaaucgagauggugcacgaugguggcaaagagacuuggcauucagcugccaccgcaaucuauugcuugauggggaguggacagcuacugugggacacagugaccggcgucgauauggcccucuga

SEQ ID NO: 150670 - RNA, 1401 nt, Artificial Sequence
  derived and/or modified sequence opt3 from neuraminidase__InfluenzaB__ABL77039
augcugcccagcaccauccagacacucacucuuuuccugacguccggcgggguguuguuaucucuguacgucucagccagucuaagcuaucuccuguacuccgacauucuucugaaguuuucuccuaccgagacaacugcuccaaccaugccguuggauugcgcaaacgccucgaauguucaagcggugaacuguucagcuacaaaaggaguaacccuccugcugcccgaaccugaguggacuuauccaagacucagcugccccgguaguacauuccagaaggccuuacugauauccccucacagguuuggcgaaaccaaaggcaauucugcaccacuuaucauucgggagcccuucaucgccuguggaccuaaggaaugcaaacauuuugcuuugacgcacuacgcagcccagccaggcgguuauuacaacgggacucgcgaggaccgaaauaagcugcgucaucuaauuagcgugaagcucggaaaaaucccgaccgucgagaacuccauauuccacauggcugccuggucaggcagugcgugucaugauggcaaggaauggacauauaucgggguggacggacccgauagcaaugcacugcuuaaaauuaaguacggugaggccuacacugacaccuaucacucuuacgcuaacaauauccugagaacacaggaauccgccugcaacuguauuggcgggaauugcuauuugaugaucaccgauggaucagcaagcggcauaagugaguguagguuucucaaaauucgggagggucgcaucauuaaggaaaucuucccuacggggagaguugagcacacugaagagugcacauguggauuugcuucuaacaagaccaucgaaugcgccugcagggacaauuccuacacugcgaaacggccauucgugaagcugaacgucgagacagauaccgccgagauucgcuuaauguguacggaaaccuaucuggacacaccccgaccugaugacggcagcauaacuggcccaugcgagucgaauggggauaaaggaucugguggcaucaaagggggauuugugcaucaaagaauggcauccaagauugggaggugguacucacggaccaugaguaagacaaaacguauggguauggggcucuauguaaaguacgacggcgaccccuggacugauagcgacgcucuugcccuguccggaguuauggugucuauggaggaaccgggcugguacagcuucggguuugaaaucaaggauaaaaagugugacgucccuugcauaggaauugagauggugcacgaugguggcaaagagaccuggcauucagcugccacagcaaucuauuguuugauggggaguggacagcuacugugggacaccgugacuggcgucgauauggcccucuga

SEQ ID NO: 150671 - RNA, 1401 nt, Artificial Sequence
  derived and/or modified sequence opt3 from neuraminidase__InfluenzaB__ABL77050
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaaggaauguaaacauuuugcauugacacacuacgccgcucagccaggcgguuauuacaacgggacccgagaggaccguaauaagcugagacaucuaaucagcgugaagcucggaaaaauaccgacggucgagaacuccaucuuccacauggccgcguggucaggcagugcaugccaugauggcaaggaauggacuuauauugggguggacggacccgauagcaaugcccugcuuaaaaucaaguacggugaggcuuacaccgacacauaucacucuuacgccaacaauauucugaggacucaggaauccgcauguaacugcaucggcgggaauuguuauuugaugauaaccgauggaucagcuagcggcauuagugagugccgguuucucaaaauccgcgaggguagaauuaucaaggaaaucuucccuacagggaggguuaagcacaccgaggaauguacgugcggauuugccucuaacaaaacuauugagugugcgugccgggacaauuccuacacagccaagcgcccauucgugaaacugaacgucgaaaccgauacugcagagauacgauuaaugugcacagagaccuaucuggacacgcccagaccugaugacggcagcaucaccggcccaugugaaucgaauggggauaagggaucugguggcauuaaagggggauuugugcaucaaaggauggcuuccaagaucggccggugguacucacguacaaugaguaaaacuaagcgcauggguauggggcucuauguaaaguacgacggcgaccccuggaccgauagcgacgcccuugcucuguccggaguuauggugucuauggaggaaccgggcugguacagcuucggguuugagauaaaagauaagaaaugcgacgucccuuguauuggaaucgaaauggugcacgaugguggcaaggagacauggcauucagccgcaacugccaucuauugcuugauggggaguggacagcuacugugggacaccgugacaggcgucgauauggcucucuga

SEQ ID NO: 150672 - RNA, 1401 nt, Artificial Sequence
  derived and/or modified sequence opt3 from neuraminidase__InfluenzaB__ABL77072
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcagagaguggacuuauaucggcguggacgggccagauucuaacgcccugauuaagaucaaauacggagaggcuuacaccgacacauaucacuccuacgccaauaacauacuuaggacucaagaaucagcaugcaauuguauugguggcgauugcuaucugaugaucaccgacgggagcgcuaguggaauuucuaagugucgguuuuugaaaauccgcgagggcagaaucauuaaggagauauucccgacagguagggucgaacauaccgaggaaugcacguguggguuugccuccaacaagacuaucgagugcgcgugucgggauaauagcuacacagccaaacgccccuucgugaagcucaacguugaaaccgacacugcagagauucgacugaugugcacagagaccuauuuagauacgccuagaccagacgauggaucgaucaccggccccugcgaaucuaauggcgacaaaggguccggagguauaaagggcggguuugugcaccagaggauggcuucaaaaauuggacggugguacagucguacaaugagcaagacuaaacgcaugggcauggagcuguaugucaaguacgacggugauccuuggaccgacuccgaugcccucgcuccaucuggggugaugguaagcaucaaggaaucaggcugguacaguuucggauucgagaucaaagacaagaaaugugauguucccugcauuggcaucgaaauggugcaugacgggggaaagacaacuuggcacuccgccgcaaccgccauuuauugucuuauggguagcggccagcuguugugggauacagucaccgggguggacauggcucuauga

SEQ ID NO: 150673 - RNA, 1401 nt, Artificial Sequence; identical to SEQ ID NO: 150600
  derived and/or modified sequence opt3 from neuraminidase__InfluenzaB__ABL77083

SEQ ID NO: 150674 - RNA, 1401 nt, Artificial Sequence; identical to SEQ ID NO: 150600
  derived and/or modified sequence opt3 from neuraminidase__InfluenzaB__ABL77094

SEQ ID NO: 150675 - RNA, 1401 nt, Artificial Sequence
  derived and/or modified sequence opt3 from neuraminidase__InfluenzaB__ABL77105
augcugcccagcaccauccagacacucacucuuuuccugacguccggcgggguguuguuaucucuguacgucucagccagucuaagcuaucuccuguacuccgacauucuucugaaguuuucuucgaccgagauaacagcuccuacuaugccauuggauugcgcaaacgccucaaauguucaagcggugaacagaagcgcuaccgaaggaguaacacuccugcugccggagcccgaauggaccuauccuaggcucaguuguccagguuccacuuuccagaaagccuuacugaucucuccccaccgguuuggcgagacaaaggggaauagcgcaccucuuauuauccgcgaaccauucauugccugcggacccaaagaguguaagcauuuugcuuugacccacuacgcagcccagccuggcgguuauuacaacgggacgcgagaggaccguaauaaacugagacaucuaaucuccgugaagcucggaaagauaccaacugucgaaaacucaaucuuccacauggcugccuggaguggcagcgcgugccaugauggcaaagaguggaccuauauugggguggacggaccggauucuaaugcacugcuuaagaucaaauacggugaagccuacacagacacuuaucacuccuacgcuaacaauauucugaggacccaggagucagccuguaacugcaucggcgggaauuguuauuugaugauaacagauggaagcgcaaguggcauuucugagugccgguuucucaagauccgcgaagguagaauuaucaaagagaucuuccccaccgggaggguugaacacacggaggaauguacuugcggauuugcuuccaacaagacaauugagugugccugccgggacaauagcuacaccgcgaagcgcccuuucgugaaacugaacgucgagacugauacagccgaaauacgauuaaugugcaccgagacguaucuggacaccccaagacccgaugacggcucgaucacaggcccuugugaaucuaauggggauaagggauccgguggcauuaaagggggauuugugcaucaaaggauggcaucaaagaucggccggugguacagucguacuaugagcaaaaccaagcgcauggguauggggcucuauguaaaauacgacggcgacccauggacagauuccgacgcucuugcccugucuggaguuauggugagcauggaggaacccggcugguacucauucggguuugagauaaaggauaagaaaugcgacgucccguguauuggaaucgagauggugcacgaugguggcaaggaaacuuggcauagugcugccaccgcaaucuauugcuugaugggguccggacagcuacugugggacacagugaccggcgucgauauggcccucuga

SEQ ID NO: 150676 - RNA, 1401 nt, Artificial Sequence; identical to SEQ ID NO: 150600
  derived and/or modified sequence opt3 from neuraminidase__InfluenzaB__ABL77127

SEQ ID NO: 150677 - RNA, 1401 nt, Artificial Sequence
  derived and/or modified sequence opt3 from neuraminidase__InfluenzaB__ABL77138
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcagagaauggacuuauaucggcguggacgggccagauucuaacgcccugauuaagaucaaauacggagaggcuuacaccgacacauaucacuccuacgccaauaacauacuuaggacucaagaaucagcaugcaauuguauugguggcgauugcuaucugaugaucaccgacgggagcgcuaguggaauuucuaagugucgguuuuugaaaauccgcgagggcagaaucauuaaggagauauucccgacagguagggucgaacauaccgaggaaugcacguguggguuugccuccaacaagacuaucgagugcgcgugucgggauaauagcuacacagccaaacgccccuucgugaagcucaacguugaaaccgacacugcagagauucgacugaugugcacagagaccuauuuagauacgccuagaccagacgauggaucgaucaccggccccugcgaaucuaauggcgacaaaggguccggagguauaaagggcggguuugugcaccagaggauggcuucaaaaauuggacggugguacagucguacaaugagcaagacuaaacgcaugggcauggagcuguaugucaaguacgacggugauccuuggaccgacuccgaugcccucgcuccaucuggggugaugguaagcaucgaggagcccggcugguacucauucggauucgaaaucaaggacaaaaagugugauguuccgugcauuggcaucgagauggugcaugacgggggaaaaacaacuugguauagugccgcaaccgccauuuacugucuuauggguuccggccagcuguugugggauacagucaccgggguggacauggcucuauga

SEQ ID NO: 150678 - RNA, 1401 nt, Artificial Sequence; identical to SEQ ID NO: 150600
  derived and/or modified sequence opt3 from neuraminidase__InfluenzaB__ABL77149

SEQ ID NO: 150679 - RNA, 1401 nt, Artificial Sequence
  derived and/or modified sequence opt3 from neuraminidase__InfluenzaB__ABL77160
augcugcccagcaccauccagacacucacucuuuuccugacguccggcgggguguuguuaucucuguacgucucagccagucuaagcuaucuccuguacuccgacauucuucugaaguuuucucaaaccaaaauaacagcuccuacuaugccauuggauugcgcaaacgccucgaauguucaggcggugaacagaucagcuaccaagggaguaacacuccugcugccggagcccgaauggaccuauccuaggcucagcuguccagguaguacuuuccagaaagccuuacugaucucuccccaccgguuuggcgagacaaagggaaauuccgcaccucuuauuauccgcgaaccauucauugccugcgggcccaaagaguguaagcauuuugcuuugacccacuacgcagcccagccuggcgguuauuacaacgggacgcgagaagaccguaauaagcugagacaucuaaucagcgugaaacucggaaagauaccaacugucgagaacuccaucuuccacauggcugccuggucaggcagugcgugccaugauggcagggaguggaccuauauugggguggacggaccggauagcaaugcacugcuuaaaaucaaguacggugaagccuacacagacacuuaucacucuuacgcuaaaaacauucugcggacccaagaguccgccuguaauugcaucggcggggauuguuauuugaugauaacagacggaucagcaagcggcauuagugaaugccgcuuucucaagaucagagaggguaggauuaucaaggagaucuuccccaccgggcggguuaaacacacggaagaguguacuugcggauuugcuucuaacaagacaauugaaugugccugccgcgauaauuccuacaccgcgaaacgaccuuucgugaagcugaacgucgagacugacacagccgaaauaagauuaaugugcaccgagacguaucuggauaccccaaggcccaaugacggcagcaucacaggcccuugugagucggauggggaccggggaucugguggcauuaaagggggauuugugcaucagcguauggaauccaagaucggccgcugguacucaagaacuaugaguaaaaccaagaggauggguauggggcucuauguaaaguacgacggcgauccauggacagacagcgaggcacuugcucuguccggaguuauggugucuauggaggaacccggcugguacagcuucggguuugaaauaaaagauaagaaaugcgacgucccguguauuggaaucgagauggugcacgaugguggcaagacuaccuggcauucagccgcuacaaccaucuauugcuugauggggaguggacagcuacugugggacacugugacgggcgucgauauggcccucuga

SEQ ID NO: 150680 - RNA, 1401 nt, Artificial Sequence; identical to SEQ ID NO: 150632
  derived and/or modified sequence opt3 from neuraminidase__InfluenzaB__ABL77171

SEQ ID NO: 150681 - RNA, 1401 nt, Artificial Sequence
  derived and/or modified sequence opt3 from neuraminidase__InfluenzaB__ABL77182
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcagagaauggacuuauaucggcguggacgggccagauucuaacgcccugauuaagaucaaauacggagaggcuuacaccgacacauaucacuccuacgccaauaacauacuuaggacucaagaaucagcaugcaauuguauugguggcgauugcuaucugaugaucaccgacgggagcgcuaguggaauuucuaagugucgguuuuugaaaauccgcgagggcagaaucgucaaggagauuuucccgacagguaggguggaacauaccgaggaaugcacguguggguuugccuccaacaagacuauagagugcgcgugucgggauaauagcuacacagccaaacgccccuucguuaagcucaacguggaaaccgacacugcagagauccgacugaugugcacagagaccuauuuagauacgccuagaccagacgauggaucgauuaccggccccugcgaaucuaauggcgacaaaggguccggagguaucaagggcggguuuguccaccagaggauggcuucaaaaauaggacggugguacagucguacaaugagcaagacuaaacgcaugggcauggagcuguaugugaaguacgacggugauccuuggaccgacuccgaugcccucgcuccaucugggguaaugguuagcauugaggagcccggcugguacucauucggauucgaaaucaaggacaaaaagugugaugugccgugcaucggcauugagaugguccaugacgggggaaaaacaacuuggcacagugccgcaaccgccaucuauugucuuauggguuccggccagcuguugugggauacaauuaccgggguggacauggcucuauga

SEQ ID NO: 150682 - RNA, 1401 nt, Artificial Sequence; identical to SEQ ID NO: 150607
  derived and/or modified sequence opt3 from neuraminidase__InfluenzaB__ABL77193

SEQ ID NO: 150683 - RNA, 1401 nt, Artificial Sequence
  derived and/or modified sequence opt3 from neuraminidase__InfluenzaB__ABL77204
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugauccccgaaccugaguggaccuauccaaggcugagcugucccgguaguacuuuccagaaggcccucuuaauuuccccucaccgguuuggcgaaacaaaaggaaauucugcaccacugaucauucgcgagcccuucaucgccugcgggccuaaggaauguaaacauuuugcucuuacccacuacgcagcccagccaggcgguuauuacaacgggacgcgaggagaccguaauaaguugagacaucugauaagcgugaagcuaggcaaaaucccgacugucgagaacuccauuuuccacauggcugccuggucaggcagugcgugccaugaugggaaggaguggaccuauaucggaguggacggucccgauaauagcgcacuccugaaaauuaaguacggcgaagccuacacagacacuuaucacucuuacgcuaacaauauccuuaggacccaggaguccgccuguaacugcauagggggaaauuguuaucugaugauuacagauggcucagcaagcgguguuagugaaugccgguuuuugaaaauccgcgaggggagaauuaucaaggagaucuucccuaccggaagggugaagcacacggaagaguguacuugcggcuuugcuucuaacaaaacaauugaaugugccugccgggacaauuccuacaccgcgaagcgcccauucgucaaacucaacguggagacugauacagccgaaauacgacugaugugcaccgagacguauuuagacacccccagaccugaugacggcagcaucacagggccaugugagucgaauggagauaaggguucuggcgggauuaaaggaggcuuuguacaucaaaggauggcauccaagaucggucggugguacucacguacuaugaguaaaaccaagcgcauggggaugggccuguauguuaaguacgacggagaccccugggcugauagcgacgcccucgcucuuuccggcgugauggucucuauggaggaaccggggugguacagcuucggauuugaaauaaaagauaagaaaugcgacgugccuuguauugguaucgagauggugcacgauggcgggaaggaaacauggcauucagccgcaacugccaucuauugccugaugggaaguggccaguugcuaugggacaccgucacagguguugauauggcucuguga

SEQ ID NO: 150684 - RNA, 1401 nt, Artificial Sequence
  derived and/or modified sequence opt3 from neuraminidase__InfluenzaB__ABL77215
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccugggcugauagugacgcccuugcuuucagcggcguuaugguguccauggaggaaccggggugguacucuuuuggauucgaaauaaaagauaagaaaugcgacgucccuuguauugguaucgagauggugcacgauggcgggaaggaaacauggcauagcgccgcaacugccaucuauugccugaugggaucaggccaguugcuaugggacaccgugacaggugucaacauggcucuguga

SEQ ID NO: 150685 - RNA, 1401 nt, Artificial Sequence; identical to SEQ ID NO: 150643
  derived and/or modified sequence opt3 from neuraminidase__InfluenzaB__ABL77226

SEQ ID NO: 150686 - RNA, 1401 nt, Artificial Sequence
  derived and/or modified sequence opt3 from neuraminidase__InfluenzaB__ABL77237
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaucaaaggauggcaucuaaaauuggucggugguacucccguacuaugucaaagaccgagcgcauggggaugggccucuauguuaaauacgacggagaucccugggcugacagugaugcccuugcuuucagcggcgugauggucuccaugaaggaaccggggugguacucuuuuggauucgagaucaaggacaaaaagugcgaugugccuuguauagguauugaaauggugcacgacggcgggaaagagacauggcauagcgccgcaacugccaucuauugccugaugggaucaggccaguugcuaugggauaccgucacagguguugacauggcucuguga

SEQ ID NO: 150687 - RNA, 1401 nt, Artificial Sequence
  derived and/or modified sequence opt3 from neuraminidase__InfluenzaB__ABL77248
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaaugucucucgauugcgcaaacgccucgaauguucaagcggcuaaccacucagccacuaaggagaugaccuuccugcugccggaacccgaguggacauauccuagacucagcugucagggaaguaccuuucagaaagcauuacugauuuccccacauagguucggugaagccaagggcaauucugcuccccuuaucauucgggagccuuuuaucgcaugcgggccaaaagaauguaagcacuucgccuugacucauuacgcugcccagcccggaggcuauuacaacgguacacgcgaggaccgaaauaagcugcgucaccuaauaagcgugaaccucgggaaaaucccuaccguagaaaauuccauuuuucauauggcggcauggucaggaagugccugccacgauggcagagaguggacguauaucggcguggacgggccagauagcaacgcucugauuaagaucaaauacggagaggccuacacugacaccuaucacucuuacgcaaauaacauacuuaggacacaagaauccgcuuguaauugcauugguggcgauuguuaucugaugaucacugacgggucagccagcggaauuaguaagugccgguucuugaaaauccgcgagggcagaaucauuaaggagauauuuccgaccgguagggucgaacauacagaggaauguaccugcggguucgcgucuaacaagacgaucgagugugccugccgggauaauuccuacacugcaaaacgccccuuugugaagcucaacguugaaacagacaccgcugagauucgacugaugugcacugagacauauuuagauaccccuagaccagacgauggaagcaucacgggccccugugaaucgaauggcgagaaagggaggggagguauaaagggcggguucgugcaccagcggauggccucuaaaauuggacguugguacucccgcaccaugucaaagacagaaagaaugggcauggagcuguaugucaaauacgacggugacccuuggacugauagugacgcucucgccccaagcggggugaugguauccaugaaggaacccggcugguacucuuuuggauucgagaucaaggauaaaaagugcgacguuccguguaucggcauugagauggugcaugauggggguaaaaagaccuggcacagcgcagccacagcuaucuauugccuuaugggaucaggccagcuguugugggacacugucaccgggguggauauggcgcuauga

SEQ ID NO: 150688 - RNA, 1401 nt, Artificial Sequence
  derived and/or modified sequence opt3 from neuraminidase__InfluenzaB__ABL77259
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaaaaguuccguuggauugcgcaaacgccucgaaugugcaagcgguaaacagaucagcuacuaagggaaugacccuccugcugagcgaacccgaguggacauauccuaggcucaguugucaggguuccaccuuccagaaagccuuacugaucucuccacaccgguuuggcgaaacucgcgggaauagcgcaccccuuauuauccgagagccuuucauugccugcggaccaaaggaauguaaacauuuugcuuugacacacuacgcagcccagcccggcgguuauuacaacgggacccgugaggacagaaauaagcugaggcaucuaaucuccgugaagcucggaaaaauaccuacggucgagaacucaaucuuccacauggcugccuggaguggcagcgcgugccaugauggccgggaauggacuuauauugggguggacggaccagauucuaaugcacugaucaagauuaaauacggugaggccuacaccgacacauaucacuccuacgcuaacaauauccuucgcacucaagaaucagccuguaacugcauaggcggggauuguuaucugaugauuaccgacggaagcgcaaguggcaucucuaagugcagauuuuugaaaauuagggagggucggaucaucaaggagauuuucccgacagggcgcguugaacacaccgaggaauguacgugcggauuugcuuccaauaagacuauagagugugccugccgagauaacagcuacacagcgaaaagacccuucgugaagcucaaugucgaaaccgacacugccgagaucaggcugaugugcacagagaccuauuuagauacgccucggccagacgauggcucgauuaccggccccugugaaucuaacggggacaaaggacgugguggcaucaaagggggauuugugcaucagcgcauggcauccaagauaggcagaugguacucaaggacaaugaguaagacugagcggauggguauggaacuguauguaaaauacgacggggauccuuggaccgacagcgaugcucucgccccauccggcguuauggugucuaugaaggagcccggaugguacagcuucggcuuugaaauuaaggacaaaaagugcgaugucccguguaucgggaucgagauggugcacgacggagguaaaaagacauggcauucagcugccacugcaauuuauugccuuaugggcagugggcagcuguugugggauaccgugacaggagucgacauggcccuauga

SEQ ID NO: 150689 - RNA, 1401 nt, Artificial Sequence
  derived and/or modified sequence opt3 from neuraminidase__InfluenzaB__ABL77270
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaaugacacuccugcugcccgaaccugaguggaccuauccaaggcucagcugucccgguaguacuuuccagaaggccuuacugaucuccccucaccgguuuggcgaaacacgcggaaauucugcaccacuuauuauccgagagcccuucauugccugcgggccuaaagaauguaagcauuuugcuuugacccacuacgcagcccagccaggcgguuauuacaacgggacgcgugaggacagaaauaaacugaggcaucuaaucagcguaaagcucggaaagauaccgacuguggagaacuccaucuuccacauggcugccuggucaggcagugcgugccaugauggccgggaauggaccuauauuggggucgacggacccgauagcaaugcacugaucaaaauuaaguacggugaggccuacacagacacuuaucacucuuacgcuaacaauauccuucgcacccaggaauccgccuguaacugcauaggcggggauuguuaucugaugauuacagacggaucagcaagcggcaucaguaaaugcagauuuuugaagauuagggagggucggaucaucaaagagauuuucccuaccgggcgcguggaacacacggaggaauguacuugcggauuugcuucuaauaagacaauagagugugccugccgagauaacuccuacaccgcgaagagaccauucguuaaacucaauguggaaacugacacagccgagaucaggcugaugugcaccgagacguauuuagauacaccccggccugacgauggcagcauuaccggcccaugugaaucgaacggggacaagggacgugguggcaucaaagggggauuuguccaucaacgcauggcaucuaagauaggcagaugguacuccaggacuaugucaaaaaccgagcggauggguauggaacuguaugugaaguacgacggggaucccuggacagacagugaggcucucgccccgagcggcguaaugguuuccauggaggaaccuggaugguacucuuucggcuuugagauuaaagauaagaagugcgacgugcccuguaucgggaucgaaaugguccacgauggagguaaaaagacuuggcauagcgcugccaccgcaauuuauugccuuaugggcucagggcagcuguugugggacacagugaccggaguggauauggcccuauga

SEQ ID NO: 150690 - RNA, 1401 nt, Artificial Sequence
  derived and/or modified sequence opt3 from neuraminidase__InfluenzaB__ABL77281
augcugcccagcaccauccagacacucacucuuuuccugacguccggcgggguguuguuaucucuguacgucucaguuagucuaagcuaucuccuguacuccgacauucuucugagauuuucuccuaccgagauaacagccccaacuaugccguuggauugcgcuaacgcaucgaaugugcaagccguaaacaggucagcgaccaagggaaugacacuccggcugcccgaaccugaguggaccuauccacgccugagcugucccgguaguacuuuccagaaagcucucuuaaucuccccucaccgauuuggcgaaacacguggaaauucugccccacugauuaucagagagcccuucauugcaugcgggccuaaggaauguaaacauuuugcccuuacccacuacgcugcacagccaggcgguuauuacaacgggacgagggaggaccggaauaaguugcgccaucugaucagcgugaaacuaggaaagauaccgacugucgagaacuccaucuuccacauggccgcuuggucaggcagugccugccaugauggcagagaauggaccuauauugggguggacggacccgauagcaaugcgcucaucaagauuaaauacggugaggcauacacagacacuuaucacucuuacgccaacaauauccugaggacccaggaauccgcuuguaacugcauaggcggggauuguuaucuuaugauuacagacggaucagccagcgagaucaguaagugccgguuucugaaaauucgcgagggccgaaucaucaaggaaauuuucccuaccgguagaguugagcacacggaagaguguacuugcggguuugcaucuaauaaaacaauagaaugugcuugcagggauaacuccuacaccgccaagcggccauucgugaaguugaaugucgagacugacacagcggagauccgucucaugugcaccgaaacguaucuggauacaccccgcccugacgauggaagcauuaccggcccaugugagucgaacggcgacaaagggagaggagguaucaagggcggguuugugcaucaaaggauggccucuaaaauaggacggugguacucccgaacuaugucaaagaccgaacgcaugggcauggaguuauauguaaaauacgacggugaucccuggacagacagugaagcacuggcuccgagcgggguuaugguguccauggaggagccuggcugguacucuuucggauuugaaauuaaggauaaaaagugcgacguccccuguaucggcaucgagauggugcacgaugggggaaagaaaacuuggcauagcgccgcuaccgccauuuauugccucauggguucaggccagcuucugugggacacagugaccggggucgauauggcauuguga

SEQ ID NO: 150691 - RNA, 1401 nt, Artificial Sequence
  derived and/or modified sequence opt3 from neuraminidase__InfluenzaB__ABL77292
augcugcccagcaccauccagacacucacucuuuuccugacguccggcgggguguuguuaucucuguacgucucagccagucuaagcuaucuccuguacuccggaguucuucugaaguuuucuccuaccgagauuacagcuccaacuaugccguuggacugcgcaaacgccucgaaugugcaagcgguaaacagaucagcuaccaaaggugugacacuccugcugcccgaaccugaguggaccuauccaaggcucagcugucccggcaguacuuuccagaaggccuuacugauauccccucaccgguuuggggaaacacgcggaaauucugcaccacuuaucauucgagagcccuucaucgccugcggcccuaaagaauguaagcauuuugcuuugacccacuacgcagcccagccagguggguauuacaacggaacgcgugaggauagaaauaaaaugaggcaucugauuagcgucaagcuaggcaagaucccgacuguggagaacuccauauuccacauggcugccuggucaggcagugcgugccaugacgggcgggaauggaccuauaucggaguugauggucccgacagcaaugcacucauuaaaaucaaguacggcgaggccuacacagauacuuaucacucuuacgcuaacaauauucugcgcacccaggaauccgccuguaacugcaucgggggagacuguuaucuuaugauaacagauggcucagcaagcgguauuaguaaaugcagauuucugaagaucagggaggggcggauuaucaaagagaucuucccuaccggacgcguggaacacacggaggaauguacuugcggcuuugcuucuaauaagacaauugagugugccugccgagacaacuccuacaccgcgaagagaccauucgucaaauugaauguggaaacugauacagccgagauaaggcucaugugcaccgagacguaucuggacacaccccggccugaugacggcagcaucaccgggccaugugaaucgaacggagauaaggguuuaggcgggauuaaaggaggcuuuguacaucaacguauggcaucuaagaucggucgcugguacuccagaacuaugucaaaaaccgagaggauggggauggaacuguauguuaaguacgacggcgaccccuggacagauagugacgcucucgcccuuagcggagugauggucuccauggaggaaccgggcugguacucuuucggguuugagauaaaagauaagaagugcgacgugccuuguauuggaaucgagauggugcacgaugguggcaaaaagacuuggcauagcgcugccaccgcaaucuauugccugauggggucaggacaguugcuaugggacacagucaccggcguugauauggcccuguga

SEQ ID NO: 150692 - RNA, 1398 nt, Artificial Sequence
  derived and/or modified sequence opt3 from neuraminidase__InfluenzaB__ABL77303
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccauuucucucgauugcgcaaacgccucgaauguucaagcggugaaccacucagcuacaaaggagaugacuuuccugcugccggaacccgaguggaccuauccuagacucagcugucagggaaguaucuuucagaaagccuuacugauuuccccacauagguucggugaagcaaagggcaauucugcuccccuuaucauacgggagccuuuuaucgccugcgggccaaaagaauguaagcacuucgcauugacacauuacgccgcucagcccggaggcuauuacaacgguacccgcgaggaccgaaauaagcugcgucaccuaauuagcguaaaccucgggaaaaucccuacuguggaaaauuccauuuuucauauggccgcguggucaggaagugcaugccacgauggcagagaguggacauauaucggcgucgacgggccagauagcaacgcccugauaaagauuaaauacggagaggcuuacaccgacacguaucacucuuacgccaauaacauccuuaggacucaagaauccgcauguaauugcauugguggcgauuguuaucugaugaucaccgacgggucagcuagcggaaucaguaagugccgguucuugaaaauucgcgagggcagaauaaucaaggagauuuuuccgacagguaggguggaacauacugaggaauguaccugcggguucgccucuaacaagacaaucgagugugcgugccgggauaauuccuacaccgccaaacgccccuuuguuaagcucaacguggaaacggacacugcagagauacgacugaugugcacagagaccuauuuagauacuccuagaccagacgauggaagcauuacaggccccugugaaucgaauggcgacaaagggaggggaggugucaagggcggguucgugcaccagcggaucgcuucuaaaaucggacguugguacucccgcaccaugucaaagacggagagaaugggcauggaacuguauguaaaauacgacggugauccuuggaccgacagugaugcccucgcuccaagcgggguuaugguguccauggaggaacccggcugguacucuuuuggauucgagauuaaggacaagaaaugcgaugucccguguaucggcauugagauggugcaugacgggggaaagaaaacauggcacagcgccgcaacugccauauauugccuuauggguucaggccagcuguugugggauaccgugacaggggucgacauggcucuauga

SEQ ID NO: 150693 - RNA, 1398 nt, Artificial Sequence
  derived and/or modified sequence opt3 from neuraminidase__InfluenzaB__ABL77314
augcugcccagcaccauccagacacucacucuuuuccugacguccggcgggguguuguuaucucuguacgucucagcccuacucaguuaucugcuuuacagcgacguucuguugaaguuuuccccuaaaauuauagcuccaaccaugucucucgauugcgcaaacgccucgaaugugcaagcgguaaaccacucagcuacagaggaaaugacuuuccugcugccggagcccgaauggaccuauccuagacucagcugucagggaaguacauuucagaaggccuuacugaucuccccacauagguucggugaggcaaaaggcaauucugcuccccuuauuauccgggaaccuuuuauugcuugcgggccaaaggaguguaaacacuucgcauugacccauuacgccgcucagcccggaggcuauuacaacgguacucgcgaggaccgaaauaagcugcgucaccuaaucagcgugaaccucgggaagauaccuacagucgaaaauuccaucuuucauauggccgcguggucaggaagugcaugccacgauggcagagaguggaccuauauuggcguggacgggccagauagcaacgcccugaucaaaauuaaguacggagaagccuacacggacacuuaucacucuuacgccaauaacauccuuaggacccaagaguccgcauguaauugcauagguggcgauuguuaucugaugauuacagacgggucagcuagcggaaucaguaaaugccgguucuugaagauucgcgagggcagaaucaucaaagaaauuuuuccgacugguaggguugagcauaccgaagaguguacaugcggguucgccucuaacaagaccauagaaugugcgugccgggauaauuccuacacggccaagcgccccuuugugaaacucaacgucgagacugacacagcagagauccgacugaugugcaccgaaacuuauuuagauacaccuagaccagacgauggaagcauuaccggccccugugagucgaauggcgacaaggggcacggagguaucaaaggcggguucgugcaucagaggauggcuucuaagauaggacggugguacucccguacgaugucaaaaaccaagcgcaugggcauggaacuguauguaaaauacgacggugauccuuggacagacagugaugcccucgcuccaagcgggguuaugguguccauggaggaacccggcugguacucuuuuggauucgagauuagagacaagaagugcgaugucccguguaucggcaucgagauggugcacgacggggguaaaaagacuuggcacagcgccgcaaccgccauuuauugccuuaugggaucaggccagcuguugugggauacagugacuggggucgacauggcucuauga

SEQ ID NO: 150694 - RNA, 1401 nt, Artificial Sequence
  derived and/or modified sequence opt3 from neuraminidase__InfluenzaB__ABL77325
augcugcccagcaccauccagacacucacucuuuuccugacguccggcgggguguuguuaucucuguacgucucagcccuacucaguuauagccuguacuccgacauucuucugaaguuuucuccuaccaaaacaauagcuccaacuaugucguuggauugcgcaaacgccucaaauguucaagcggugaaccacagcgcuaccaagggaaugacacuccugcugccggagcccgaauggaccuauccuagacucaguugucaggguuccacuuuccagaaagccuuacugaucucuccacauagguuuggcgagacaaaggggaauagcgcaccccuuauuauccgggaaccuuucauugccugcggaccaaaagaguguaagcacuuugcuuugacccauuacgcagcccagcccggcgguuauuacaacgggacgcgcgaagaccgaaauaagcugcgucaccuaaucuccguaucacucggaaaaauaccuacuguggagaacaguaucuuccauauggcugccuggagcggcucugcgugccacgauggcagagaguggaccuauauuggggucgacggaccagauuccaaugcacugaucaagauuaaauacggugaagccuacacagacacuuaucacucauacgcuaacaauauccuuaggacccaagagagcgccuguaacugcauaggcggggauuguuaucugaugauuacagacggaagugcaucuggcaucuccaagugccgguuuuugaaaauucgcgaagguagaaucaucaaggagauuuucccgaccgggaggguggaucauacggaggaauguacuugcggauuugcuagcaauaagacaauagagugugccugccgggacaacucguacaccgcgaaacgccccuucguuaagcucaauguggaaacugauacagccgagauccgacugaugugcaccgaaacguauuuagacaccccuagaccagaugacggcucuauuacaggccccugugaguccaacggggacaaaggaagggguggcaucaaagggggauuuguccaccagcggauggcaucaaagauaggccguugguacagucgcacuaugagcaagaccgagagacuggguauggaacucuaugugaaauacgauggggacccuuggacagauuccgacgcucuugccccaucuggcguaaugguuagcgcugaggaacccggaugguacucauucggcuuugagauuaaggauaagaaaugcgacgugccguguaucgggaucgaaaugguccaugauggagguaagaaaacuuggcacagugccgcaaccgccauuuauugccugaugggcuccgggcaguugcuaugggacacagugaccggaguggauauggcucuguga

SEQ ID NO: 150695 - RNA, 1401 nt, Artificial Sequence
  derived and/or modified sequence opt3 from neuraminidase__InfluenzaB__ABL77336
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaccgaugcccuuggauugcgcaaacgccucgaauguucaagcggugaacagaucagcuacuaaaggaguaacccuccugcugccugaaccagaguggacauaucccaggcucagcuguccugguaguaccuuccagaaggccuuacugaucuccccacaccgguuuggcgaaacucgcggaaauucugcaccccuuauuauccgagagccuuucauugccugcgggccaaaagaauguaagcauuuugcuaucacacacuacgcagcccagccgggcgguuauuacaacgggacccgugaggacagaaauaaauugaggcaucugauaagcgugaagcuaggaaagauccccacggucgagaacuccauuuuccacauggcugccuggucaggcagugcgugccaugauggccgggaauggacuuauaucgggguggacggaccugauagcaaugcacuccugaaaauuaaguacggugaggccuacaccgacacauaucacucuuacgcuaacaauauccuucgcacucaggaauccgccuguaacugcauaggcggggauuguuaucugaugauuaccgacggaucagcaagcggcaucaguaaaugcagauuuuugaagauuagggagggucggaucaucaaagagauuuucccaacagggcgcguugaacacaccgaggaauguacgugcggauuugcuucuaauaagacuauagagugugccugccgagauaacuccuacacagcgaagagacccuucgugaaacucaaugucgaaaccgacacugccgagaucaggcugaugugcacagagaccuauuuagauacgccucggccagacgauggcagcauuaccggccccugugaaucgaacggggacaagggacgugguggcaucaaagggggauuugugcaucaacgcauggcaucuaagauaggcagaugguacuccaggacaaugucaaaaacugaccggauggguauggagcuguauguaaaguacgauggggacccguggaccgauagugacgcucucgcccuuagcggcguuaugguguccauggaggaaccuggaugguacucuuucggcuuugaaauuaaagauaagaagugcgacguccccuguaucgggaucgagauggugcacgauggagguaaaaagacauggcauagcgcugccacuaccauuuauugccugaugggcucagggcaguugcuaugggacacagugaccggagucgauauggcacuguga

SEQ ID NO: 150696 - RNA, 1401 nt, Artificial Sequence
  derived and/or modified sequence opt3 from neuraminidase__InfluenzaB__ABL77347
augcugcccagcaccauccagacacucacucuuuuccugacguccggcgggguguuguuaucucuguacgucucagccagucuaagcuaucuccuguacuccgacauucuucugaaguuuucuccuaccaaaauaacagcuccaacuaugccguuggauugcgcaaacgccucgaauguucaagcggugaaccacucagcuaccaagggaguaacacuccugcugcccgagccugaauggaccuauccaagacucagcugucccgguaguacuuuccagaaagccuuacugaucuccccucauagguuuggcgagacacggggaaauucugcaccacuuauuauccgcgaacccuucauugccugcgggccuaaggaguguaaacacuuugcuuugacccauuacgcagcccagccaggcgguuauuacaacgggacgcgagaagaccguaauaagcugagacaccuaaucagcgugaagcucggaaaaauaccgacugucgagaacuccaucuuccauauggcugccuggucaggcagugcgugccacgauggcagggaguggaccuauauugggguggacggacccgauagcaaugcacugcuuaagaucaaauacggugaagccuacacagacacuuaucacucuuacgcuaacaauauucugcggacccaggaguccgccuguaacugcaucggcggggauuguuauuugaugauaacagacggaucagcaagcggcauuagugaaugccgcuuucucaagaucagagaggguaggauuaucaaagagaucuucccuaccgggcggguugaacauacggaggaauguacuugcggauuugcuucuaauaagacaauugagugugccugccgcgauaacuccuacaccgcgaagcgaccauucgugaaacugaaugucgaaacugacacagccgagauaagauuaaugugcaccgagacguaucuggauacccccaggccugacgauggcagcaucacaggcccaugugaaucgaacggggacaagggaucugguggcauuaaagggggauuugugcaccaacggauggcauccaagaucggccguugguacucacgcacuaugaguaaaaccaagagaauggguauggggcucuauguaaaauacgacggcgaucccuggacagacagcgaugcucuugcccuguccggaguuauggugucuauggaggaaccgggcugguacagcuucggguuugagauaaaggacaagaaaugcgaugucccuuguauuggaaucgaaauggugcaugacgguggcaagaaaacuuggcacucagcugccaccgcaaucuauugcuugauggggaguggacagcuacugugggauacagugaccggcgucgacauggcccucuga

SEQ ID NO: 150697 - RNA, 1398 nt, Artificial Sequence
  derived and/or modified sequence opt3 from neuraminidase__InfluenzaB__ABL77380
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccacaucucucgauugcgcaaacgccucgaauguucaagcggugaaccacucagcuacuaaggagaugaaauuccugccgcccgaaccugaguggaccuauccaagacugagcugucagggaaguacauuucagaaggcccucuuaauuucuccccauagguucggugaagcaaaaggcaauuccgccccucugaucauucgggagccauuuaucgcuugcgggcccaaggaauguaagcacuucgcacuuacccauuacgccgcucagccuggaggcuauuacaacgguacucgcgaggaccgaaauaaauugcgucaccugauaagcguaaaccuagggaagaucccaacaguggaaaauuccauuuuucauauggccgcguggucaggaagugcaugccacgauggcagagaauggaccuauaucggcgucgacgggccggauagcaacgcccucauuaaaaucaaguacggagaggcuuacacggacacuuaucacucuuacgccaauaacauacugaggacccaagaauccgcauguaauugcauugguggcgauuguuaucuuaugaucacagacgggucagcuagcggaauuaguaaaugccgguuccugaagauccgcgagggcagaaucauuaaggagauauuucccacugguaggguggaacauaccgaggaauguacaugcggguucgccucuaacaaaaccaucgagugugcgugccgggauaauuccuacacggccaagcgcccuuuuguuaaauugaacguggaaacugacacagcagagauucgacucaugugcaccgagacuuaucuggauacaccaagacccgacgauggaagcaucaccggcccuugugaaucgaauggcgacaaggggucuggaggugucaaaggcggguucgugcaccagaggauggcuuccaagauaggacggugguacucacguacgaugaguaaaaccaagcgcaugggcauggaguuauauguaaaguacgacggugauccauggacagacagcgaugcccuggcucccuccgggguuauggugucuauggaggagccgggcugguacagcuuuggauucgaaauuaaagacaagaaaugcgaugucccuuguaucggcaucgagauggugcaugacgggggaaagagaacuuggcacucagccgcaaccgccauuuauugccucauggguaguggccagcuucugugggauacagugacuggggucaacauggcuuuguga

SEQ ID NO: 150698 - RNA, 1401 nt, Artificial Sequence
  derived and/or modified sequence opt3 from neuraminidase__InfluenzaB__ABL77391
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgagacguaucuggacacccccagaccugaugacggcuccauaacagggccaugugagagcaacggagauaaggguucgggcgggaucaaaggaggcuuuguacaucaaaggauggcaucuaagauuggucggugguacucccguacuaugucaaaaaccaagcgcauggggaugggccucuauguuaaguacgacggagaccccugggcugauagugacgcccuugcucugagcggcgugauggucuccauggaggaaccggggugguacucuuucggauuugaaaucaaagauaagaaaugcgacgugccuuguauagguauugagauggugcacgauggcgggaaggaaacauggcauagcgccgcaacugccaucuauugcuugaugggaucaggccagcuacugugggacaccgucacagguguugauauggcucucuga

SEQ ID NO: 150699 - RNA, 1401 nt, Artificial Sequence
  derived and/or modified sequence opt3 from neuraminidase__InfluenzaB__ABL84344
augcugcccagcaccauccagacacucacucuuuuccugacguccggcgggguguuguuaucucuguacgucucagccagucuaagcuaucuccuguacuccgacauucuucugaaguuuucuucgaccgagauaacagcuccuacuaugccauugaacugcgcaaaugccucaaacguucaagcggugaaucacagcgcuaccaaaggaguaacacucccgcugcccgaaccugaguggaccuauccaagacugaguugucccgguuccacuuuccagaaggcccucuuaaucucuccucauagguuuggcgaaacaaaagggaacagcgcaccacugauuauccgggagcccuucauugccugcggaccuaaggaauguaaacacuuugcucuuacccauuacgcagcccagccaggcgguuauuacaaugggacgcgcgaggaucgaaacaaguugcgucaccugaucuccgugaagcuaggaaaaauaccgacugucgaaaauucaaucuuccauauggcugccuggaguggcagcgcgugccacgacggcagagaauggaccuauauugggguggauggacccgacucuaacgcacuccugaagaucaaauacggugaggccuacacagauacuuaucacuccuacgcuaauaacauucuuaggacccaggaaucagccuguaauugcaucggcggggacuguuaucugaugauaacagauggaagcgcaaguggcguuucugagugccgguuuuugaagauucgcgaggguagaaucauuaaagaaaucuucccuaccgggaggguggagcauacggaagaguguacuugcggauuugcuuccaacaagacaaucgaaugugccugccgggacaauagcuacaccgcgaagcgcccauucgucaaacucaacguggagacugauacagccgagauucgacugaugugcaccgaaacguauuuagacacccccagaccugaugacggcucgauaacaggcccaugugagucuaauggggauaagggauccgguggcaucaaagggggauuuguacaccaaaggauggcaucaaagauuggccggugguacagucguacuaugagcaaaaccaagcgcauggguauggggcuguauguuaaauacgacggcgaccccuggaucgauuccgacgcucucacacuuucuggagugauggucagcauggaggagccgggcugguacucauucggguuugaaauaaaggauaagaaaugcgacgugccuuguauuggaaucgagauggugcaugaugguggcaaggagacuuggcacagugccgcuaccgccaucuauugccugaugggguccggacaguugcuaugggacacagucaccggcguugauauggcacuguga

SEQ ID NO: 150700 - RNA, 1401 nt, Artificial Sequence
  derived and/or modified sequence opt3 from neuraminidase__InfluenzaB__ABN50397
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugaacugcgcaaaugccucgaacguucaagcggugaauagaucagcuaccaaaggaguaacacuccugcugcccgaaccugaguggaccuauccaaggcucagcugucccgguaguacuuuccagaaggccuuacugaucuccccucaccgguuuggcgaaacaaaagggaacucugcaccacuuauuauccgcgagcccuucauugccugcggaccuaaggaauguaaacauuuugcuuugacccacuacgcagcccagccaggcgguuauuacaaugggacgcgagaggaucguaacaagcugagacaucuaaucagcgugaagcucggaaaaauaccgacugucgaaaauuccaucuuccacauggcugccuggucaggcagugcgugccaugacggcagggaauggaccuauauugggguggauggacccgacagcaacgcacugcuuaagaucaaauacggugaggccuacacagauacuuaucacucuuacgcuaauaacauucugcggacccaggaauccgccuguaauugcaucggcggggacuguuauuugaugauaacagauggaucagcaagcggcauuagugagugccgcuuucucaagaucagagaggguaggauuaucaaagaaaucuucccuaccgggcggguugagcacacggaagaguguacuugcggauuugcuucuaacaagacaauugaaugugccugccgcgacaauuccuacaccgcgaagcgaccauucgugaaacugaacgucgagacugauacagccgagauaagauuaaugugcaccgaaacguaucuggacacccccaggccugaugacggcagcaucacaggcccaugugagucgaauggggauaagggaucugguggcauuaaagggggauuugugcaucaacggauggcauccaagaucggccguugguacucacgcacuaugaguaaaaccaagagaauggguauggggcucuauguaaaauacgacggcgaccccuggauagauagcgacgcucuuacacuguccggaguuauggugucuauggaggagccgggcugguacagcuucggguuugaaauuaaggauaagaaaugcgacgucccuuguaucggaaucgagauggugcacgaugguggcaagaaaacuuggcauucagccgcuaccgccauuuauugcuugauggggaguggacagcuacugugggacacagugaccggcgucgauauggaccucuga

SEQ ID NO: 150701 - RNA, 1401 nt, Artificial Sequence
  derived and/or modified sequence opt3 from neuraminidase__InfluenzaB__ABN50408
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugaacugcgcaaaugccucgaacguucaagcggugaauagaucagcuaccaaaggaguaacacucccccugccugaaccagaguggaccuaucccaggcugagcuguccugguaguacuuuccagaaggcccucuuaaucuccccacaccgguuuggcgaaacaaaagggaacucugcaccccugauuauccgcgagccuuucauugccugcggaccaaaggaauguaaacauuuugcucuuacccacuacgcagcccagccgggcgguuauuacaaugggacgcgagaggaucguaacaaguugagacaucugaucagcgugaagcuaggaaaaauacccacugucgaaaauuccaucuuccacauggcugccuggucaggcagugcgugccaugacggcagggaauggaccuauauugggguggauggaccugacagcaacgcacuccugaagaucaaauacggugaggccuacacagauacuuaucacucuuacgcuaauaacauucuucggacccaggaauccgccuguaauugcaucggcggggacuguuaucugaugauaacagauggaucagcaagcggcauuagugagugccgcuuuuugaagaucagagaggguaggauuaucaaagaaaucuucccaaccgggcggguugagcacacggaagaguguacuugcggauuugcuucuaacaagacaauugaaugugccugccgcgacaauuccuacaccgcgaagcgacccuucgugaaacucaacgucgagacugauacagccgagauaagacugaugugcaccgaaacguauuuagacaccccuaggccagaugacggcagcaucacaggccccugugagucgaauggggauaagggaucugguggcauuaaagggggauuugugcaucaacggauggcauccaagaucggccguugguacucacgcacuaugaguaaaaccaagagaauggguauggggcuguauguaaaauacgacggcgacccguggauagauagcgacgcucucacacuuuccggaguuauggugucuauggaggagccuggcugguacagcuucggguuugaaauuaaggauaagaaaugcgacguccccuguaucggaaucgagauggugcacgaugguggcaagaaaacuuggcauucagccgcuaccgccauuuauugccugauggggaguggacaguugcuaugggacacagugaccggcgucgauauggcacuguga

SEQ ID NO: 150702 - RNA, 1401 nt, Artificial Sequence
  derived and/or modified sequence opt3 from neuraminidase__InfluenzaB__ABN50419
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggcucugugagucgaauggagauaaggguucuggcgggauuaaaggaggcuuugugcaucaaaggauggcauccaagaucggucggugguacucacguacuaugaguaaaaccaagcgcauggggaugggccuuuauguaaaguacgacggagacccauggacagauagcgacgcucuggccuuguccggcguuauggugucuauggaggaacccgggugguacagcuucggauuugaaauaaaagauaagaaaugcgacgucccguguauugguaucgagauggugcacgauggcgggaaggaaacuuggcauucagcugccaccgcaaucuauugccuaaugggaaguggccagcugcucugggacacagugaccggugucgauauggcccuguga

SEQ ID NO: 150703 - RNA, 1401 nt, Artificial Sequence
  derived and/or modified sequence opt3 from neuraminidase__InfluenzaB__ABN50430
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggccaugugagucgaauggagauaaggguucuggcgggauuaaaggaggcuuugugcaucaaaggauggcauccaagaucggucggugguacucacguacuaugaguaaaaccaagcgcauggggaugggccucuauguaaaguacgacggagaccccuggacagauagcgacgcucuugcccuguccggcguuauggugucuauggaggaaccggggugguacagcuucggauuugaaauaaaagauaagaaaugcgacgucccuuguauugguaucgagauggugcacgauggcgggaaggaaacuuggcauucagcugccaccgcaaucuauugcuugaugggaaguggccagcuacugugggacacagugaccggugucgauauggcccucuga

SEQ ID NO: 150704 - RNA, 1401 nt, Artificial Sequence; identical to SEQ ID NO: 150686
  derived and/or modified sequence opt3 from neuraminidase__InfluenzaB__ABN50463

SEQ ID NO: 150705 - RNA, 1401 nt, Artificial Sequence; identical to SEQ ID NO: 150600
  derived and/or modified sequence opt3 from neuraminidase__InfluenzaB__ABN50474

SEQ ID NO: 150706 - RNA, 1401 nt, Artificial Sequence
  derived and/or modified sequence opt3 from neuraminidase__InfluenzaB__ABN50485
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggccaugugaguuuaauggagauaaggguucgggcgggauuaaaggaggcuucgugcaucaaaggauggcaucuaagaucggucggugguacucccguacuaugucaaaaaccaagcgcauggggaugggccucuauguaaaguacgacggagaccccuggacagauagugacgcucuugcccugagcggcguuaugguguccauggaggaaccggggugguacucuuuuggauucgaaauaaaagauaagaaaugcgacgucccuuguauugguaucgagauggugcacgauggcgggaaggaaacuuggcauagcgcugccaccgcaaucuauugcuugaugggaucaggccagcuacugugggacacagugaccggugucgauauggcccucuga

SEQ ID NO: 150707 - RNA, 1401 nt, Artificial Sequence
  derived and/or modified sequence opt3 from neuraminidase__InfluenzaB__ABN50496
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaaggguaacacuccugcugcccgaaccugaguggaccuauccacggcucagcugucccggaaguacuuuccagaaggccuuacugaucuccccucaccgcuuuggugaaacaaaaggcaauucugcaccacuuauuauccgagagcccuucauugccugcgggccuaaggaauguaaacauuuugcuuugacccacuacgcagcccagccaggaggcuauuacaacgguacgcguggggacagaaauaagcugaggcaucuaaucagcgugaagcucggaaaaauaccgacugucgagaacuccaucuuccacauggcugccuggucaggcagugcgugccaugauggcaaggaguggaccuauauugggguggacggacccgauaauaacgcacugcuuaaaaucaaguacggugaagccuacacagacacuuaucacagcuacgcuaauaacauucugcggacccaggagucugccuguaauugcaucggcgggaacuguuauuugaugauaacagauggauccgcaucaggcguuagcgaaugccgcuuucucaaaauuagagaggguaggaucauuaaggagaucuucccuaccgggcggaucaagcacacggaagaguguacuugcggauuugcuaguaauaaaacaauugaaugugccugccgcgacaacucuuacaccgcgaagcgaccauucgugaaacugaaugucgagacugauacagccgaaauaagauuaaugugcaccgagacguaucuggacacccccaggccugaugacggcuccaucacaggcccaugugagagcaacggggauaagggaucggguggcauuaaagggggauuugugcaucaacggauggcaucuaagaucggccguugguacucccgcacuaugucaaaaaccaagagaauggguauggggcucuauguaaaguacgacggcgaccccugggcugauagugacgcccuugcuuucagcggaguuaugguguccauggaggaaccgggcugguacucuuuuggguucgaaauaaaagauaagaaaugcgacgucccuuguauuggaaucgagauggugcacgaugguggcaaggaaacauggcauagcgccgcaacugccaucuauugccugauggggucaggacaguugcuaugggacaccgugacaggcgucaacauggcucuguga

SEQ ID NO: 150708 - RNA, 1401 nt, Artificial Sequence
  derived and/or modified sequence opt3 from neuraminidase__InfluenzaB__ABN50507
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugaacugcgcaaaugccucgaacguucaagcggugaauagaucagcuaccaaaggaguaacacucccccugccugaaccagaguggaccuaucccaggcugagcuguccugguaguacuuuccagaaggcccucuuaaucuccccacaccgguuuggcgaaacaaaagggaacucugcaccccugauuauccgcgagccuuucauugccugcggaccaaaggaaugucgacauuuugcucuuacccacuacgcagcccagccgggcgguuauuacaaugggacgcgugaggauagaaacaaauugaggcaucugaucagcgugaagcuaggaaagauacccacugucgaaaauuccaucuuccacauggcugccuggucaggcagugcgugccaugacggccgggaauggaccuauauugggguggauggaccugacagcaacgcacuccugaaaaucaaguacggugaggccuacacagauacuuaucacucuuacgcuaauaacauucuucgcacccaggaauccgccuguaauugcaucggcggggacuguuaucugaugauaacagauggaucagcaagcggcauuagugagugcagauuuuugaaaaucagggagggucggauuaucaaggaaaucuucccaaccgggcgcguugagcacacggaagaguguacuugcggauuugcuucuaacaaaacaauugaaugugccugccgagacaauuccuacaccgcgaagagacccuucgugaagcucaacgucgagacugauacagccgagauaaggcugaugugcaccgaaacguauuuagacaccccucggccagaugacggcagcaucacaggccccugugagucgaauggggauaaaggaucugguggcauuaaagggggauuugugcaucaacguauggcauccaagaucggccgcugguacucaagaacuaugaguaagaccaaaaggauggguauggggcuguauguaaaguacgacggcgacccguggauagauagcgacgcucucacacuuuccggaguuauggugucuauggaggagccuggcugguacagcuucggguuugaaauuaaagauaagaagugcgacguccccuguaucggaaucgagauggugcacgaugguggcaaaaagacuuggcauucagccgcuaccgccauuuauugccugauggggaguggacaguugcuaugggacacagugaccggcgucgauauggcacuguga

SEQ ID NO: 150709 - RNA, 1401 nt, Artificial Sequence; identical to SEQ ID NO: 150607
  derived and/or modified sequence opt3 from neuraminidase__InfluenzaB__ABN50518

SEQ ID NO: 150710 - RNA, 1401 nt, Artificial Sequence; identical to SEQ ID NO: 150607
  derived and/or modified sequence opt3 from neuraminidase__InfluenzaB__ABN50529

SEQ ID NO: 150711 - RNA, 1401 nt, Artificial Sequence; identical to SEQ ID NO: 150600
  derived and/or modified sequence opt3 from neuraminidase__InfluenzaB__ABN50540

SEQ ID NO: 150712 - RNA, 1401 nt, Artificial Sequence; identical to SEQ ID NO: 150632
  derived and/or modified sequence opt3 from neuraminidase__InfluenzaB__ABN50551

SEQ ID NO: 150713 - RNA, 1401 nt, Artificial Sequence
  derived and/or modified sequence opt3 from neuraminidase__InfluenzaB__ABN50562
augcugcccagcaccauccagacacucacucuuuuccugacguccggcggggccuuguuaucucuguacgugucagcucuacucaguuaucugcuuuacagcgacauucuguugaaguuuuccccuaccaaagucauagcaccaacaaugucucucgauuauacuaacgccucgaauguucaagcggugaaccacucagcuaccgaggaaaugacauuccugcugccggagcccgaauggaccuacccuagacucagcugccagggaaguacuuuucagaaggccuuacugaucuccccacauagguucggugaggcaaaaggcaauucugcuccccuuauuauccgggaaccuuuuauugcuugugggccaaaggagugcaaacacuucgcauugacacauuaugccgcucagcccggaggcuacuauaacgguacccgcgaggaccgaaauaagcugcgucaccuaaucagcguaaaccucgggaagauaccuacgguggaaaauuccaucuuucauauggccgcguggucaggaagugcaugucacgauggcagagaguggacuuacauuggcgucgacgggccagauagcaacgcccugaucaaaauuaaguacggagaagccuauaccgacacauaccacucuuaugccaauaacauccuuaggacucaagaguccgcaugcaauuguauagguggcgauugcuaccugaugauuaccgacgggucagcuagcggaaucagucggugucgcuucuugaaaauuagagagggcaggaucaucaaggaaauuuuuccgacaggucggguggagcauaccgaagagugcacguguggguucgccucuaacaaaacuauagaaugcgcgugucgcgauaauuccuauacagccaagcgacccuuuguuaagcucaacguggagaccgacacugcagagaucagacugaugugcacagaaaccuacuuagauacgccuaggccagacgauggaagcauuaccggccccugcgagucgaauggcgacaaagggaacggagguaucaagggcggguucguccaccagcggauggcuucucguauaggacgcugguauuccagaacaaugucaaaaacuaagaggaugggcauggaacuguacgugaaauacgacggugauccuuggaccgacagugaugcccucgcuccaagcgggguaaugguuuccauggaggaacccggcugguauucuuuuggauucgagauuaaggacaaaaagugugaugugccgugcaucggcaucgagaugguccaugacgggggaaagaaaacauggcacagcgccgcaacugccauuuacugucuuauggguucaggccagcuguugugggauaccgugacagggguggacauggcucuauga

SEQ ID NO: 150714 - RNA, 1401 nt, Artificial Sequence; identical to SEQ ID NO: 150703
  derived and/or modified sequence opt3 from neuraminidase__InfluenzaB__ABN50573

SEQ ID NO: 150715 - RNA, 1401 nt, Artificial Sequence
  derived and/or modified sequence opt3 from neuraminidase__InfluenzaB__ABN50584
augcugcccagcaccauccagacacucacucuuuuccugacguccggcgggguguuguuaucucuguacgucucagccagucuaagcuaucuccuguacuccgacauucuucugaaguuuucuccuaccgagauaacagcuucgacuaugccauuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuaacaauauucugaggacccaggaguccgccuguaacugcaucgggggaaauuguuauuugaugauaacagauggcucagcaagcgguguuagugaaugccgguuucucaagauucgcgaggggagaaucauuaaagagaucuuccccaccggaagggugaagcacacggaagaguguacuugcggcuuugcuucuaacaagacaaucgaaugugccugccgggacaauuccuacaccgcgaaacgcccuuucgucaagcugaacguggagagcgauacugccgaaauucgauuaaugugcacagagaccuaucuggacacgccaagacccgaugacggcucgauaaccgggccuugugagucuaacggagauaaagguuccggcgggaucaagggaggcuuuguacaucaaaggauggcaucaaaaauuggucggugguacagucguacaaugagcaagacugaacgcauggggaugggccucuauguuaaauacgacggagacccaugggcugauuccgacgcccuugcucugucuggcgugauggucagcauggaggaacccgggugguacucauucggauuugagaucaaggauaagaaaugcgacgugccguguauagguauugaaauggugcacgauggcgggaaggagaccuggcauagugccgcaacagccaucuauugcuugaugggauccggccagcuacugugggacacugucaccgguguugauauggcucucuga

SEQ ID NO: 150716 - RNA, 1401 nt, Artificial Sequence; identical to SEQ ID NO: 150600
  derived and/or modified sequence opt3 from neuraminidase__InfluenzaB__ABN50595

SEQ ID NO: 150717 - RNA, 1398 nt, Artificial Sequence
  derived and/or modified sequence opt3 from neuraminidase__InfluenzaB__ABN50606
augcugcccagcaccauccagacacucacucuuuuccugacguccggcgggguguuguuaucucuguacgucucagccagucuaagcuaucuccuguacuccgacauucuucugagauuuucuucgaagauaaccgcuccuacaaugacuuuggauugcgcaaacgccucaaauguucaagcggugaacaggagcgcuaccaaagagaugacauuccuccugccagaaccggaguggaccuauccccggcugaguugucagggauccacuuuucagaaggcccucuuaaucucuccucaccgcuucggugaagcacgaggcaauagcgccccacugauuauccgugagcccuuuauugcuugcgggccuaaagaauguaagcauuucgcacuuacacacuacgccgcucagccaggaggcuauuacaacgguaccagagaggacaggaauaaauugcggcaucugaucuccguaaagcuagggaagauacccacgguggagaacucaaucuuucacauggccgcguggaguggaagcgcaugccaugauggccgcgaauggacuuauauuggcgucgacgggccugauucuaaugcccucaucaaaauuaaguacggagaggcuuacaccgacacauaucacuccuacgccaacaauauccugagaacucaagaaucagcauguaacugcauagguggcgauuguuaucuuaugauuaccgacgggagcgcuaguggaaucucugagugcagguuccugaaaauucgggagggccgcaucaucaaggaaauuuuuccaacaggucgaguggagcacaccgaagaguguacgugcggguucgccuccaauaaaacuauagaaugugcgugcagagauaacagcuacacagccaagaggccguuuguuaaguugaauguggagaccgacacugcagagauccggcucaugugcacagaaaccuaucuggauacgccccguccugacgauggaucgauuaccggcccaugugagucugacggcgacaaagggcgcggagguaucaagggcggguucguccaucagagaauggcuuccaaaauaggaaggugguacucacggacaaugaguaagacugaacgaaugggcauggaguuauaugugaaauacgauggugaccccuggaccgauagcgacgcccuggcuccuuccgggguaaugguuucuaugaaggaaccaggcugguacagcuuuggauucgagauuaaagauaagaagugcgacgugcccuguaucggcaucgagaugguccacgauggggguaaaaagacauggcauucagccgcaacugccauuuauugccucaugggaaguggccagcuucugugggacaccgugacagggguggauauggcuuuguga

SEQ ID NO: 150718 - RNA, 1398 nt, Artificial Sequence
  derived and/or modified sequence opt3 from neuraminidase__InfluenzaB__ABN50628
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccaugucucucgauugcgcaaacgccucgaauguucaagcggugaaccacucagcuacaaaggagaugacuuuccugcugccggaacccgaguggaccuauccuagacucagcugucagggaaguacauuucagaaagccuuacugauuuccccacauagguucggugaagcaaagggcaauucugcuccccuuaucauucgggagccuuuuaucgccugcgggccaaaagaauguaagcacuucgcauugacccauuacgccgcucagcccggaggcuauuacaacgguacucgcgaggaccgaaauaagcugcgucaccuaauaagcguaaaccucgggaaaaucccuacaguggaaaauuccauuuuucauauggccgcguggucaggaagugcaugccacgauggcagagaguggaccuauaucggcgucgacgggccagauagcaacgcccugauuaagaucaaauacggagaggcuuacacggacacuuaucacucuuacgccaauaacauacuuaggacccaagaauccgcauguaauugcauugguggcgauuguuaucugaugaucacagacgggucagcuagcggaauuaguaagugccgguucuugaaaauccgcgagggcagaaucauuaaggagauauuuccgacugguaggguggaacauaccgaggaauguacaugcggguucgccucuaacaagaccaucgagugugcgugccgggauaauuccuacacggccaaacgccccuuuguuaagcucaacguggaaacugacacagcagagauucgacugaugugcaccgagacuuauuuagauacaccuagaccagacgauggaagcaucaccggccccugugaaucgaauggcgacaaagggaggggaggugucaagggcggguucgugcaccagcggauggcuucuaaaauaggacguugguacucccgcacgaugucaaagaccgagagaaugggcauggaacuguauguaaaauacgacggugauccuuggacagacagugaugcccucgcuccaagcgggguuaugguguccauggaggaacccggcugguacucuuuuggauucgagauuaaggacaagaaaugcgaugucccguguaucggcaucgagauggugcaugacgggggaaagaaaacuuggcacagcgccgcaaccgccauuuauugccuuauggguucaggccagcuguugugggauacagugacuggggucgacauggcucuauga

SEQ ID NO: 150719 - RNA, 1398 nt, Artificial Sequence
  derived and/or modified sequence opt3 from neuraminidase__InfluenzaB__ABN50639
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccaugucucucgauugcgcaaacgccucgaauguucaagcggugaaccacucagcuacaaaggagaugacuuuccugcugccggaacccgaguggaccuauccuagacucagcugucagggaaguacauuucagaaagccuuacugauuuccccacauagguucggugaagcaaagggcaauucugcuccccuuaucauucgggagccuuuuaucgccugcgggccaaaagaauguaagcacuucgcauugacccauuacgccgcucagcccggaggcuauuacaacgguacucgcgaggaccgaaauaagcugcgucaccuaauaagcguaaaacucgggaagaucccuacaguggagaacuccauuuuucauauggccgcguggucaggaagugcaugccacgauggcagagaauggaccuauaucggcgucgacgggccagauagcaaugcccuggugaaaauuaaguacggagaggcuuacacggacacuuaucacucuuacgccaacaauauccuuaggacccaagaauccgcauguaacugcauagguggcgauuguuaucugaugauuacagacgggucagcuagcggaaucaguaaaugccgguucuugaagauucgcgagggcagaaucaucaaggagauuuuuccgacugguaggguugaacauaccgaggaauguacaugcggguucgccucuaauaaaaccauagagugugcgugccgggauaacuccuacacggccaagcgccccuuugugaaacucaaugucgaaacugacacagcagagauccgacugaugugcaccgagacuuauuuagauacaccuagaccagacgauggaagcauuaccggccccugugaaucgaacggcgacaaggggaggggaggugugaaaggcggguucguacaccagcggauggcuucuaagaucggacguugguacucccgcacgaugucaaaaaccgagagaaugggcauggaacuguauguuaaguacgacggugauccuuggacagacagugaugcccucgcuccaagcggggugauggucuccauggaggaacccggcugguacucuuuuggauucgagauaaaggacaaaaagugcgaugugccguguauuggcaucgagauggugcaugacggggguaaaaagacuuggcacagcgccgcaaccgccaucuauugccuuaugggaucaggccagcuguugugggauacagucacugggguugacauggcucuauga

SEQ ID NO: 150720 - RNA, 1398 nt, Artificial Sequence
  derived and/or modified sequence opt3 from neuraminidase__InfluenzaB__ABN50650
augcugcccagcaccauccagacacucacucuuuuccugacguccggcgggguguuguuaucucuguacgucucagcccuacucaguuaucugcuuuacagcgacguucuguugaaguuuuccccuaaaauuauagcuccaaccaugucucucgauugcgcaaacgccucgaaugugcaagcgguaaaccacucagcuacagaggaaaugacuuuccugcugccggagcccgaauggaccuauccuagacucagcugucagggaaguacauuucagaaggccuuacugaucuccccacauagguucggugaggcaaaaggcaauucugcuccccuuauuauccgggaaccuuuuauugcuugcgggccaaaggaguguaaacacuucgcauugacccauuacgccgcucagcccggaggcuauuacaacgguacucgcgaggaccgaaauaagcugcgucaccuaaucagcgugaaccucgggaagauaccuacagucgaaaauuccaucuuucauauggccgcguggucaggaagugcaugccacgauggcagagaguggaccuauauuggcguggacgggccagauagcaacgcccugaucaaaauuaaguacggagaagccuacacggacacuuaucacucuuacgccaauaacauccuuaggacccaagaguccgcauguaauugcauagguggcgauuguuaucugaugauuacagacgggucagcuagcggaaucaguaaaugccgguucuugaagauucgcgagggcagaaucaucaaagaaauuuuuccgacugguaggguugagcauaccgaagaguguacaugcggguucgccucuaacaagaccauagaaugugcgugccgggauaauuccuacacggccaagcgccccuuugugaaacucaacgucgagacugacacagcagagauccgacugaugugcaccgaaacuuauuuagauacaccuagaccagacgauggaagcauuaccggccccugugagucgaauggcgacaaggggcacggagguaucaaaggcggguucgugcaucagaggauggcuucuaagauaggacggugguacucccguacgaugucaaaaaccaagcgcaugggcauggaacuguauguaaaauacgacggugauccuuggacagacagugaugcccucgcuccaagcgggguuaugguguccauggaggaacccggcugguacucuuuuggauucgagauuaaggacaagaaaugcgaugucccguguaucggcaucgagauggugcacgacgggggaaagaaaacuuggcacagcgccgcaaccgccauuuauugccuuauggguucaggccagcuguugugggauacagugacuggggucgacauggcucuauga

SEQ ID NO: 150721 - RNA, 1398 nt, Artificial Sequence
  derived and/or modified sequence opt3 from neuraminidase__InfluenzaB__ABN50661
augcugcccagcaccauccagacacucacucuuuuccugacguccggcgggguguuguuaucucuguacgucucagcccuacucaguuaucugcuuuacagcgacguucuguugaaguuuuccccuaaaaugauugcuccaaccaugucucucgauugcgcaaacgccucgaaugugcaagcgguaaaccacucagcuacagaggaaaugacuuuccugcugccggagcccgaauggaccuauccuagacucagcugucagggaaguacauuucagaaggccuuacugauauccccacauagguucggugaggcaaaaggcaauucugcuccccuuaucauucgggaaccuuuuaucgcuugcgggccaaaggaguguaaacacuucgcauugacccauuacgccgcucagcccggaggcuauuacaacgguacucgcgaggaccgaaauaagcugcgucaccuaauuagcgugaaccucgggaagaucccuacagucgaaaauuccauauuucauauggccgcguggucaggaagugcaugccacgauggcagagaguggaccuauaucggcguggacgggccagauagcaacgcccugauuaaaaucaaguacggagaagccuacacggacacuuaucacucuuacgccaauaacauucuuaggacccaagaguccgcauguaauugcaucgguggcgauuguuaucugaugauaacagacgggucagcuagcggaauuaguaaaugccgguucuugaagauccgcgagggcagaauuaucaaagaaaucuuuccgacugguaggguugagcauaccgaagaguguacaugcggguucgccucuaacaagaccauugaaugugcgugccgggauaauuccuacacggccaagcgccccuuugugaaacucaacgucgagacugacacagcagagauacgacugaugugcaccgaaacuuauuuagauacaccuagaccagacgauggaagcaucaccggccccugugagucgaauggcgacaaggggcacggagguauuaaaggcggguucgugcaucagaggauggcuucuaagaucggacggugguacucccguacgaugucaaaaaccaagcgcaugggcauggaacuguauguaaaauacgacggugauccuuggacagacagugaugcccucgcuccaagcgggguuaugguguccauggaggaacccggcugguacucuuuuggauucgagauaaaggacaagaaaugcgaugucccguguauuggcaucgagauggugcacgacgggggaaagaaaacuuggcacagcgccgcaaccgccaucuauugccuuauggguucaggccagcuguugugggauacagugacuggggucgacauggcucuauga

SEQ ID NO: 150722 - RNA, 1401 nt, Artificial Sequence
  derived and/or modified sequence opt3 from neuraminidase__InfluenzaB__ABN50683
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacacgcggaaauucugcaccacuuauuauccgagagcccuucauugccugcgggccuaaagaauguaagcauuuugcuuugacccacuacgcagcccagccaggcgguuauuacaacgggacgcgugaggacagaaauaaacugaggcaucuaaucagcgugaagcucggaaagauaccgacugucgagaacuccaucuuccacauggcugccuggucaggcagugcgugccaugauggccgggaauggaccuauauugggguggacggacccgauagcaaugcacugcuuaaaaucaaguacggugaggccuacacagacacuuaucacucuuacgcuaacaauauucugcgcacccaggaauccgccuguaacugcaucggcggggauuguuauuugaugauaacagacggaucagcaagcggcauuaguaaaugcagauuucucaagaucagggagggucggauuaucaaagagaucuucccuaccgggcgcguugaacacacggaggaauguacuugcggauuugcuucuaauaagacaauugagugugccugccgagauaacuccuacaccgcgaagagaccauucgugaaacugaaugucgaaacugacacagccgagauaagguuaaugugcaccgagacguaucuggauacaccccggccugacgauggcagcaucaccggcccaugugaaucgaacggggacaagggacucgguggcauuaaagggggauuugugcaucaacguauggcaucuaagaucggccgcugguacuccagaacuaugucaaaaaccaagaggauggguauggagcuuuauguaaaauacgacggggaucccuggacagacagugaugcucuggccuugagcggcguuauggugccgauggaggaaccuggaugguacuccuucggcuuugaaauaaaggacaagaaaugcgauguccccuguauugggaucgagauggugcacgacggagguaagaaaacuuggcauucugcugccaccgcaaucuauugccuaaugggcagcgggcagcugcucugggauacagugaccggagucgacauggcccuguga

SEQ ID NO: 150723 - RNA, 1401 nt, Artificial Sequence
  derived and/or modified sequence opt3 from neuraminidase__InfluenzaB__ABN50694
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacacgcggaaauucugcaccacuuauuauccgagagcccuucauugccugcgggccuaaagaauguaagcauuuugcuuugacccacuacgcagcccagccaggcgguuauuacaacgggacgcgugaggacagaaauaaacugaggcaucuaaucagcgugaagcucggaaagauaccgacugucgagaacuccaucuuccacauggcugccuggucaggcagugcgugccaugauggccgggaauggaccuauauugggguggacggacccgauagcaaugcacugcuuaaaaucaaguacggugaggccuacacagacacuuaucacucuuacgcuaacaauauucugcgcacccaggaauccgccuguaacugcaucggcggggauuguuauuugaugauaacagacggaucagcaagcggcauuaguaaaugcagauuucucaagaucagggagggucggauuaucaaagagaucuucccuaccgggcgcguugaacacacggaggaauguacuugcggauuugcuucuaauaagacaauugagugugccugccgagauaacuccuacaccgcgaagagaccauucgugaaacugaaugucgaaacugacacagccgagauaagguuaaugugcaccgagacguaucuggauacaccccggccugacgauggcagcaucaccggcccaugugaaucgaacggggacaagggaucugguggcauuaaagggggauuugugcaucaacguauggcauccaagaucggccgcugguacucaagaacuaugaguaaaaccaagaggauggguauggggcucuauguaaaauacgacggcgaucccuggacagacagcgaugcucuugcccuguccggaguuauggugucuauggaggaaccgggcugguacagcuucggguuugagauaaaggacaagaaaugcgaugucccuuguauuggaaucgaaauggugcacgacgguggcaagaaaacuuggcauucagcugccaccgcaaucuauugcuugauggggaguggacagcuacugugggauacagugaccggcgucgacauggcccucuga

SEQ ID NO: 150724 - RNA, 1398 nt, Artificial Sequence
  derived and/or modified sequence opt3 from neuraminidase__InfluenzaB__ABN50705
augcugcccagcaccauccagacacucacucuuuuccugacguugggcgggguguuacugucccuauacgucucugcccuccugucauaucuucuguacagugacguuuugcucaaguuuagcccuaaaaugauugcuccaaccaugucccuggauugcgcaaacgccucuaaugugcaagcgguaaaccacucggcuacagaggaaaugacuuuccugcucccggagcccgaauggaccuauccuagauuaucaugucagggaagcacauuucagaaggcccugcuuauaaguccacauagguucggugaggcaaaaggcaauuccgcccccuugaucauucgggaaccuuuuaucgcuugcgggccaaaggaguguaaacacuucgcacugacccauuacgccgcucagcccggaggcuauuacaacgguacucgcgaggaccgaaauaagcuacgucaccucauuucugugaaccuggggaagaucccuacagucgaaaauagcauauuucauauggccgcgugguccggaucagcaugccacgauggcagagaguggaccuauaucggcguggacgggccagauaguaacgcccuuauuaaaaucaaguacggagaggcuuacacggacacuuaucacagcuacgccaauaacauucugaggacccaagaaucugcauguaauugcaucgguggcgauuguuauuugaugauaacagacggguccgcuucaggaauuagcaaaugccgguuccucaagauccgcgagggcagaauuaucaaagaaaucuuuccgacugguaggguugagcauaccgaagaguguacaugcggguucgccaguaacaagaccauugaaugugcgugccgggauaauucuuacacggccaagcgccccuuugugaaacugaacgucgagacugacacagcagagauacgauuaaugugcaccgaaacuuaucuggauacaccuagaccagacgauggauccaucaccggccccugugagagcaauggcgacaaggggcacggagguauuaaaggcggguucgugcaucagaggauggcuucgaagaucggacggugguacucucguacgauguccaaaaccaagcgcaugggcauggaacucuauguaaaauacgacggugauccuuggacagacucagaugcccuugcuccaagugggguuauggugagcauggaggaacccggcugguacuccuuuggauucgagauaaaggacaagaaaugcgaugucccguguauuggcaucgagauggugcacgacgggggaaagaaaacuuggcacucugccgcaaccgccaucuauugccugauggguagcggccaguugcuaugggauacagugacuggggucgacauggcucuguga

SEQ ID NO: 150725 - RNA, 1401 nt, Artificial Sequence
  derived and/or modified sequence opt3 from neuraminidase__InfluenzaB__ABN50716
augcugcccagcaccauccagacacucacucuuuuccugacguccggcgggguguuguuaucucuguacgucucagccagucuaagcuaucuccuguacuccgguauucuucugaaguuuucuccuaccgagauaacagcuccaacuaugccguuggacugcgcaaacgccucgaauguucaagcggugaacagaucagcuaccaaaggaguaacacuccugcugcccgaaccugaguggaccuauccaaggcucagcugucccggcaguacuuuccagaaggccuuacugaucuccccucaccgguuuggggaaacacgcggaaauucugcaccacuuauuauccgagagcccuucauugccugcggcccuaaagaauguaagcauuuugcuuugacccacuacgcagcccagccagguggguauuacaacggaacgcgugaggauagaaauaaacugaggcaucuaaucagcgugaagcucggcaagauaccgacugucgagaacuccaucuuccacauggcugccuggucaggcagugcgugccaugacgggcgggaauggaccuauauuggaguggauggucccgacagcaaugcacugcuuaaaaucaaguacggcgaggccuacacagauacuuaucacucuuacgcuaacaauauucugcgcacccaggaauccgccuguaacugcaucgggggagacuguuauuugaugauaacagauggcucagcaagcgguauuaguaaaugcagauuucucaagaucagggaggggcggauuaucaaagagaucuucccuaccggacgcguugaacacacggaggaauguacuugcggcuuugcuucuaauaagacaauugagugugccugccgagacaacuccuacaccgcgaagagaccauucgugaaacugaaugucgaaacugauacagccgagauaagguuaaugugcaccgagacguaucuggacacaccccggccugaugacggcagcaucaccgggccaugugaaucgaacggagauaaggguucuggcgggauuaaaggaggcuuugugcaucaacguauggcauccaagaucggucgcugguacucaagaacuaugaguaaaaccaagaggauggggaugggccucuauguaaaauacgacggagaccccuggacagauagcgacgcucuugcccuguccggcguuauggugucuauggaggaaccggggugguacagcuucggauuugagauaaaggauaagaaaugcgacgucccuuguauugguaucgaaauggugcacgauggcgggaagaaaacuuggcauucagcugccaccgcaaucuauugcuugaugggaaguggccagcuacugugggacacagugaccggugucgauauggcccucuga

SEQ ID NO: 150726 - RNA, 1401 nt, Artificial Sequence
  derived and/or modified sequence opt3 from neuraminidase__InfluenzaB__ABN50727
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcagggaauggaccuauauugggguggacggacccgauagcaaugcacugcuuaagaucaaauacggugaggccuacacagacacuuaucacucuuacgcuaacaauauucugcggacccaggaauccgccuguaacugcaucggcggggauuguuauuugaugauaacagacggaucagcaagcggcauuagugagugccgcuuucucaagaucagagaggguaggauuaucaaagaaaucuucccuaccgggcggguugagcacacggaagaguguacuugcggauuugcuucuaauaagacaauugaaugugccugccgcgauaacuccuacaccgcgaagcgaccauucgugaaacugaaugucgagacugacacagccgagauaagauuaaugugcaccgaaacguaucuggauacccccaggccugacgauggcagcaucacaggcccaugugagucgaacggggacaagggaucugguggcauuaaagggggauuugugcaucaacggauggcauccaagaucggccguugguacucacgcacuaugaguaaaaccaagagaauggguauggggcucuauguaaaauacgacggcgaucccuggacagacagcgaugcucuugcccuguccggaguuauggugucuauggaggaaccgggcugguacagcuucggguuugaaauaaaggacaagaaaugcgaugucccuuguauuggaaucgagauggugcacgacgguggcaagaaaacuuggcauucagcugccaccgcaaucuauugcuugauggggaguggacagcuacugugggauacagugaccggcgucgacauggcccucuga

SEQ ID NO: 150727 - RNA, 1401 nt, Artificial Sequence; identical to SEQ ID NO: 150669
  derived and/or modified sequence opt3 from neuraminidase__InfluenzaB__ABN50738

SEQ ID NO: 150728 - RNA, 1401 nt, Artificial Sequence
  derived and/or modified sequence opt3 from neuraminidase__InfluenzaB__ABN50749
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggccaugugagucgaauggagauaaggguucuggcgggauuaaaggaggcuuugugcaucaaaggauggcauccaagaucggucggugguacucacguacuaugaguaaaaccaagcgcauggggaugggccucuauguaaaguacgacggagaccccugggcugauagcgacgcccuugcucuguccggcguuauggugucuauggaggaaccggggugguacagcuucggauuugaaauaaaagauaagaaaugcgacgucccuuguauugguaucgagauggugcacgauggcgggaaggaaacauggcauucagccgcaacugccaucuauugcuugaugggaaguggccagcuacugugggacaccgugacaggugucgauauggcucucuga

SEQ ID NO: 150729 - RNA, 1398 nt, Artificial Sequence
  derived and/or modified sequence opt3 from neuraminidase__InfluenzaB__ABN51188
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccaugcuccuggauugcgcaaacgccucuaauguucaagcggugaaccacucggcuacaaaggagaugacuuuccugcucccggaacccgaguggaccuauccuagauuaucaugucagggaagcacauuucagaaagcccugcuuauuaguccacauagguucggugaagcaaagggcaauuccgcccccuugaucauucgggagccuuuuaucgcuugcgggccaaaagaauguaagcacuucgcacugacccauuacgccgcucagcccggaggcuauuacaacgguacucgcgaggaccgaaauaagcuacgucaccucauaucuguaaaccuggggaaaaucccuacaguggagaauagcauuuuucauauggccgcgugguccggaucagcaugccacgauggcagagaauggaccuauaucggcgucgacgggccagauaguaacgcccuuauuaagaucaaauacggagaggcuuacacggacacuuaucacagcuacgccaauaacauacugaggacccaagaaucugcauguaauugcauugguggcgauuguuauuugaugaucacagacggguccgcuucaggaauuagcaagugccgguuccucaaaauccgcgagggcagaaucauuaaggagauauuuccgacugguaggguggaacauaccgaggaauguacaugcggguucgccaguaacaagaccaucgagugugcgugccgggauaauucuuacacggccaaacgccccuuuguuaagcugaacguggaaacugacacagcagagauucgauuaaugugcaccgagacuuaucuggauacaccuagaccagacgauggauccaucaccggccccugugaaagcaauggcgacaaagggaggggaggugucaagggcggguucgugcaccagcggauggcuucgaaaauaggacguugguacucucgcacgauguccaagaccgagagaaugggcauggaacucuauguaaaauacgacggugauccuuggacagacucagaugcccuugcuccaagugggguuauggugagcauggaggaacccggcugguacuccuuuggauucgagauuaaggacaagaaaugcgaugucccguguaucggcaucgagauggugcaugacgggggaaagaaaacuuggcacucugccgcaaccgccauuuauugccugauggguagcggccaguugcuaugggauacagugacuggggucgacauggcucuguga

SEQ ID NO: 150730 - RNA, 1398 nt, Artificial Sequence; identical to SEQ ID NO: 150718
  derived and/or modified sequence opt3 from neuraminidase__InfluenzaB__ABN51199

SEQ ID NO: 150731 - RNA, 1401 nt, Artificial Sequence
  derived and/or modified sequence opt3 from neuraminidase__InfluenzaB__ABN58665
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaaugucucucgauugcgcaaacgccucgaauguucaagcggugaaccacucagcuacugaggaaaugaccuuccugcugccggagcccgaauggacauauccuagacucagcugucagggaaguaccuuucagaaggccuuacugauuuccccacauagguucggugaggcaaaaggcaauucugcuccccuuaucauucgggaaccuuuuaucgcuugcgggccaaaggaguguaaacacuucgcauugacucauuacgccgcucagcccggaggcuauuacaacgguacacgcgaggaccgaaauaagcugcgucaccuaauaagcguaaaccucgggaagaucccuaccguggaaaauuccauuuuucauauggccgcguggucaggaagugcaugccacgauggcagagaguggacguauaucggcgucgacgggccagauagcaacgcccugauuaaaaucaaguacggagaagccuacacugacaccuaucacucuuacgccaauaacauacuuaggacacaagaguccgcauguaauugcauugguggcgauuguuaucugaugaucacugacgggucagcuagcggaauuaguaaaugccgguucuugaagauccgcgagggcagaaucauuaaagaaauauuuccgaccgguaggguggagcauacagaagaguguaccugcggguucgccucuaacaagacgaucgaaugugcgugccgggauaauuccuacacugccaagcgccccuuuguuaaacucaacguggagacagacaccgcagagauucgacugaugugcacugaaacauauuuagauaccccuagaccagacgauggaagcaucacgggccccugugagucgaauggcgggaagggaucugguggcauaaaagggggauucguccaccagaggauggcuuccaagauuggccggugguacucacguaccaugaguaaaacaaagcgcauggguauggaacuguaugugaaauacgacggggacccuuggacugauagcgacgcccucgcuccauccggcguaaugguuucuauggaggaacccggaugguacagcuuuggcuucgagaucaaggauaagaaaugcgacgugccguguaucgggauugagaugguccaugauggagguaagaaaaccuggcacucagccgcaacagccaucuauugccuuaugggcagugggcagcuguugugggacacugugaccggaguggauauggcucuauga

SEQ ID NO: 150732 - RNA, 1401 nt, Artificial Sequence; identical to SEQ ID NO: 150619
  derived and/or modified sequence opt3 from neuraminidase__InfluenzaB__ABN59449

SEQ ID NO: 150733 - RNA, 1398 nt, Artificial Sequence; identical to SEQ ID NO: 150697
  derived and/or modified sequence opt3 from neuraminidase__InfluenzaB__ABR15999

SEQ ID NO: 150734 - RNA, 1401 nt, Artificial Sequence; identical to SEQ ID NO: 150726
  derived and/or modified sequence opt3 from neuraminidase__InfluenzaB__ABR16010

SEQ ID NO: 150735 - RNA, 1401 nt, Artificial Sequence
  derived and/or modified sequence opt3 from neuraminidase__InfluenzaB__ABR16021
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcaaggggagaaucauuaaggagaucuucccuaccggaagggugaaacacacggaggaauguacuugcggcuuugcuaguaauaagacaaucgagugugccugccgggacaacucuuacaccgcgaaacgcccauucgucaagcugaauguggaaacugauacagccgagauucgauuaaugugcaccgacacguaucuggauacccccagaccugacgauggcuccauaacagggccaugugaaagcaacggagacaaagguucgggcgggaucaagggaggcuuuguacaucaaaggauggcaucuaaaauuggucggugguacucccguacuaugucaaagaccgagcgcauggggaugggccucuauguuaaguacgacggagaucccugggcugacagugaugcccuugcuuucagcggcgugauggucuccaugaaagagccggggugguacucuuuuggauucgaaaucaaggacaaaaagugcgaugugccuuguauagguauugagauggugcacgacggcgggaaagaaacauggcauagcgccgcaacugccaucuauugccugaugggaucaggccaguugcuaugggauaccgucacagguguugacauggcucuguga

SEQ ID NO: 150736 - RNA, 1401 nt, Artificial Sequence; identical to SEQ ID NO: 150651
  derived and/or modified sequence opt3 from neuraminidase__InfluenzaB__ACA64903

SEQ ID NO: 150737 - RNA, 1401 nt, Artificial Sequence
  derived and/or modified sequence opt3 from neuraminidase__InfluenzaB__ACA64914
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgccaagaacauucugaggacucaagaauccgcauguaauugcaucggcggggauuguuauuugaugauaaccgacggacccgcuucaggcauuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaaaaacuaagcgcauggguauggggcucuauguuaaguacgacggcgaucccuggaccgacagugaggcccuugcucugagcggagugauggucuccauggaugaaccgggcugguacucuuucggguuugagauaaaagacaagaaaugcgaugugccuuguauuggaaucgaaauggugcacgacgguggcaagacaacuuggcauagcgccgcaaccgccaucuauugcuugauggggucaggacagcuacugugggauacagucaccggcguugacauggcucucuga

SEQ ID NO: 150738 - RNA, 1401 nt, Artificial Sequence; identical to SEQ ID NO: 150651
  derived and/or modified sequence opt3 from neuraminidase__InfluenzaB__ACA64936

SEQ ID NO: 150739 - RNA, 1401 nt, Artificial Sequence
  derived and/or modified sequence opt3 from neuraminidase__InfluenzaB__ACA64969
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcugccaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagaucaaauacggcgaggcuuacaccgacacauaucacagcuacgccaacaagauucugaggacucaggagucugcauguaauugcaucgggggaaacuguuauuugaugauaaccgauggcuccgcuucagguguuagcgaaugccgguuucucaaaauucgcgaggggagaaucauuaaggagaucuucccuacaggaagggugaagcacaccgaagaguguacgugcggcuuugccaguaauaaaacuaucgaaugugcgugccgggacaacucuuacacagccaagcgcccauucgucaaacugaauguggagaccgauacugcagaaauucgauuaaugugcacagacaccuaucuggauacgcccagaccugacgauggcuccauaaccgggccaugugagagcaacggagacaaggguucgggcgggaucaaaggaggcuuuguacaucaaaggauggcuucuaagauuggucggugguacucccguacaaugucaaaaacugagcgcauggggaugggccucuauguuaaguacgacggagaucccugggccgacagugaugcucuugccuucagcggcgugauggucuccaugaaggaaccggggugguacucuuuuggauucgagaucaaagacaagaaaugcgaugugccuuguauagguauugaaauggugcacgacggcgggaaggagaccuggcauagcgcagccacagcuaucuauugccugaugggaucaggccaguugcuaugggauacugucaccgguguugacauggcgcuguga

SEQ ID NO: 150740 - RNA, 1401 nt, Artificial Sequence
  derived and/or modified sequence opt3 from neuraminidase__InfluenzaB__ACA64980
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuuccaagauucugaggacccaggagucagccuguaacugcaucgggggaaauuguuauuugaugauaacagauggcagcgcaagugguguuucugaaugccgguuucucaaaauucgcgaggggagaaucauuaaggagaucuuccccaccggaagggugaagcacacggaagaguguacuugcggcuuugcuuccaacaaaacaaucgaaugugccugccgggacaauagcuacaccgcgaagcgcccuuucgucaaacugaacguggagacugauacagccgaaauucgauuaaugugcaccgacacguaucuggauaccccaagacccgacgauggcucgauaacagggccuugugagucuaauggagacaaggguuccggcgggaucaaaggaggcuuuguacaucaaaggauggcaucaaagauuggucggugguacagucguacuaugagcaaaaccgagcgcauggggaugggccucuauguuaaguacgacggagauccaugggcugacuccgaugcccuugcuuucucuggcgugauggucagcaugaaggaacccgggugguacucauuuggauucgagaucaaagacaagaaaugcgaugugccguguauagguauugaaauggugcacgacggcgggaaggagacauggcauagugccgcaacugccaucuauugccugaugggauccggccaguugcuaugggauaccgucacagguguugacauggcucuguga

SEQ ID NO: 150741 - RNA, 1401 nt, Artificial Sequence
  derived and/or modified sequence opt3 from neuraminidase__InfluenzaB__ACA64991
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaccagaggauggcaucuaaaauuggucggugguacucccguacuaugucaaagaccgagcgcauggggaugggccucuauguuaaauacgacggagaucccugggcugacagugaugcccuugcuuucggcggggugauggucagcaugaaggaaccgggaugguacuccuuugguuucgagaucaaggacaaaaagugcgaugugccuuguauaggcauugaaauggugcaugacgggggaaaagagacauggcacucugccgcaacugccaucuauugccugaugggcagcggucaauugcuaugggauaccgucacagggguugacauggcucuguga

SEQ ID NO: 150742 - RNA, 1401 nt, Artificial Sequence; identical to SEQ ID NO: 150651
  derived and/or modified sequence opt3 from neuraminidase__InfluenzaB__ACA65013

SEQ ID NO: 150743 - RNA, 1401 nt, Artificial Sequence; identical to SEQ ID NO: 150651
  derived and/or modified sequence opt3 from neuraminidase__InfluenzaB__ACA65024

SEQ ID NO: 150744 - RNA, 1401 nt, Artificial Sequence
  derived and/or modified sequence opt3 from neuraminidase__InfluenzaB__ACA65035
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuucuaagauucugaggacccaggaguccgccuguaacugcaucgggggaaauuguuauuugaugauaacagauggcucagcaagcgguguuagugaaugccgguuucucaaaauucgcgaggggagaaucauuaaggagaucuucccuaccggaagggugaagcacacggaagaguguacuugcggcuuugcuucuaacaaaacaaucgaaugugccugccgggacaauuccuacaccgcgaagcgcccauucgucaaacugaacguggagacugauacagccgaaauucgauuaaugugcaccgacacguaucuggauacccccagaccugacgauggcagcauaacagggccaugugagucgaauggagacaaggguucuggcgggaucaaaggaggcuuuguacaucaaaggauggcauccaagauuggucggugguacucacguacuaugaguaaaaccgagcgcauggggaugggccucuauguuaaguacgacggagaucccugggcugacagcgaugcccuugcuuucuccggcgugauggucucuaugaaggaaccggggugguacagcuuuggauucgagaucaaagacaagaaaugcgaugugccuuguauagguauugaaauggugcacgacggcgggaaggagacauggcauucagccgcaacugccaucuauugccugaugggaaguggccaguugcuaugggauaccgucacagguguugacauggcucuguga

SEQ ID NO: 150745 - RNA, 1401 nt, Artificial Sequence; identical to SEQ ID NO: 150651
  derived and/or modified sequence opt3 from neuraminidase__InfluenzaB__ACA65046

SEQ ID NO: 150746 - RNA, 1401 nt, Artificial Sequence
  derived and/or modified sequence opt3 from neuraminidase__InfluenzaB__ACA65057
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggaggccgauacugcagaaauucgauuaaugugcacagacaccuaucuggauacgcccagaccugacgauggcuccauaaccgggccaugugaguuuaacggagacaaggguagcggcgggaucaaaggaggcuucguacaucaaaggauggcuucgaagauuggucggugguacucucguacaauguccaaaacugagcgcauggggaugggccucuauguuaaguacgacggagaucccugggccgacucagaugcucuugccuuuaguggcgugauggucagcaugaaggaaccggggugguacuccuucggauucgagaucaaagacaagaaaugcgaugugccuuguauagguauugaaauggugcacgacggcgggaaggagaccuggcauucugcagccacagcuaucuauugccugaugggaagcggccaguugcuaugggauacugucaccgguguugacauggcgcuguga

SEQ ID NO: 150747 - RNA, 1401 nt, Artificial Sequence; identical to SEQ ID NO: 150651
  derived and/or modified sequence opt3 from neuraminidase__InfluenzaB__ACA65068

SEQ ID NO: 150748 - RNA, 1401 nt, Artificial Sequence; identical to SEQ ID NO: 150651
  derived and/or modified sequence opt3 from neuraminidase__InfluenzaB__ACA65079

SEQ ID NO: 150749 - RNA, 1401 nt, Artificial Sequence; identical to SEQ ID NO: 150651
  derived and/or modified sequence opt3 from neuraminidase__InfluenzaB__ACA65090

SEQ ID NO: 150750 - RNA, 1401 nt, Artificial Sequence; identical to SEQ ID NO: 150651
  derived and/or modified sequence opt3 from neuraminidase__InfluenzaB__ACA65101

SEQ ID NO: 150751 - RNA, 1401 nt, Artificial Sequence
  derived and/or modified sequence opt3 from neuraminidase__InfluenzaB__ACA96567
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugagugggccuauccaaggcucagcugucccgguaguaccuuccaaaaggcauuacugaucuccccucaucgguuuggcgaaacuaaaggaaauucugccccacuuauuauccgcgagcccuucauugcuugcgggccuaacgaauguaagcacuuugcauugacacauuacgccgcucagccaggcgguuauuacaaugggacccgaggagaccguaacaaacugagacaccuaaucagcgugaagcucggcaagauaccgacggucgaaaauuccaucuuccauauggccgcguggucaggcagugcaugccacgaugggaaagaguggacuuauauuggaguggacggucccgauaacaaugcccugcuuaagaucaaauacggcgaggcuuacaccgacacauaucacagcuacgccaacaauauucugaggacucaggagucugcauguaacugcaucgggggaaauuguuauuugaugauaaccgauggcuccgcuucagguguuagcgaaugccgguuucucaagauucgcgaggggagaaucauuaaagagaucuucccuacaggaagggugaagcauaccgaagaguguacgugcggcuuugccaguaacaagacuaucgaaugugcgugccgggacaauucuuacacagccaaacgcccauucgucaagcugaacguggagaccgauacugcagaaauucgauuaaugugcacagacaccuaucuggauacgcccagaccugacgauggcuccauaaccgggccaugugagagcaacggagacaaagguucgggcgggaucaagggaggcuuuguacaccagaggauggcuucuaaaauuggucggugguacucccguacaaugucaaagacugagcgcauggggaugggccucuauguuaaauacgacggagaucccugggccgacagugaugcucuugccuucagcggcaucaugguguccaugaaggaaccggggugguacucuuuuggauucgagauaaaggacaaaaagugcgaugucccuuguauugguaucgaaauggugcaugacggcgggaaagagaccuggcacagcgcagccacagcuaucuauugccugaugggaucaggccaauugcuaugggauacugugaccggugucgacauggcgcuguga

SEQ ID NO: 150752 - RNA, 1401 nt, Artificial Sequence; identical to SEQ ID NO: 150651
  derived and/or modified sequence opt3 from neuraminidase__InfluenzaB__ACA96578

SEQ ID NO: 150753 - RNA, 1401 nt, Artificial Sequence; identical to SEQ ID NO: 150739
  derived and/or modified sequence opt3 from neuraminidase__InfluenzaB__ACA96589

SEQ ID NO: 150754 - RNA, 1401 nt, Artificial Sequence; identical to SEQ ID NO: 150651
  derived and/or modified sequence opt3 from neuraminidase__InfluenzaB__ACA96600

SEQ ID NO: 150755 - RNA, 1401 nt, Artificial Sequence
  derived and/or modified sequence opt3 from neuraminidase__InfluenzaB__ACA96611
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauuaugcaaacgccucgaauguucacgcggugaaccauucagcuaccaaaggaguaacacuccugcugcccgaaccugaguggaccuacccaagacucagcugccccgguaguacuuuccaaaaggccuuacugaucuccccucacagguuuggcgaaacaaaaggaaauucugcaccacuuauuauccgggagcccuucauugccugugggccuaacgaaugcaagcauuuugcuuugacccacuaugcagcccagccaggcgguuacuauaaugggacgcgcggagaccgaaacaaacugcgucaucuaaucagcgugaagcucggcaagauaccgacugucgaaaauuccaucuuccacauggcugccuggucaggcagugcgugucacgaugggaaagaguggaccuacauuggaguggacggucccgauaacaaugcacugcuuaagaucaaauacggcgaggccuauacagacacuuaccauagcuaugcuaacaauauucugagaacccaggagucugccugcaacuguaucgggggaaauugcuacuugaugauaacagauggcuccgcaucagguguuagcgaauguagguuucucaagauucgggaggggcgcaucauuaaagagaucuucccuaccggaagagugaagcacacggaagagugcacuuguggcuuugcuaguaacaagacaaucgaaugcgccuguagggacaauucuuauaccgcgaaacggccauucgucaagcugaacguggagacugauacagccgaaauucgcuuaaugugcaccgacacguaccuggauacaccccgaccugacgauggcuccauaaccgggccaugcgagagcaacggagacaaagguucgggcgggaucaagggaggcuuuguacaucagagaauggcaucuaaaauugguaggugguauucccggacuaugucaaagaccgagcguauggggaugggccucuacguuaaauacgacggagaucccugggcugacagugaugcccuugcuuucagcggcgugauggucuccaugaaggaaccggggugguauucuuuuggauucgagaucaaggacaaaaagugugaugugccuugcauagguauugaaauggugcacgacggcgggaaagagacauggcacagcgccgcaacugccaucuacugucugaugggaucaggccgcuugcuaugggauaccgucacagguguugacauggcucuguga

SEQ ID NO: 150756 - RNA, 1401 nt, Artificial Sequence
  derived and/or modified sequence opt3 from neuraminidase__InfluenzaB__ACA96622
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaaucgggccaugugagagcaacggagacaaagguucgggcgggauuaagggaggcuuuguacaccagaggauggcaucuaaaaucggucggugguacucccguacaaugucaaagacugagcgcauggggaugggccucuauguuaaauacgacggagaucccugggcugacagugaugcccuugcuuucagcggcgugauggucuccaugaaggaaccggggugguacucuuuuggauucgagauaaaggacaaaaagugcgaugugccuuguauugguaucgaaauggugcaugacggcgggaaagagaccuggcacagcgccgcaacagccaucuauugccugaugggaucaggccaauugcuaugggauacugucaccgguguugacauggcucuguga

SEQ ID NO: 150757 - RNA, 1401 nt, Artificial Sequence; identical to SEQ ID NO: 150739
  derived and/or modified sequence opt3 from neuraminidase__InfluenzaB__ACA96633

SEQ ID NO: 150758 - RNA, 1401 nt, Artificial Sequence
  derived and/or modified sequence opt3 from neuraminidase__InfluenzaB__ACA96644
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcauaaagcucggcaagaucccgacuguggaaaauuccauuuuccacauggcugccuggucaggcagugcgugccaugaugggaaagaguggaccuauaucggagucgacggucccgauaacaaugcacugcuuaagauuaaauacggcgaggccuacacagacacuuaucacagcuacgcuaacaagauccugaggacccaggagucugccuguaauugcauagggggaaacuguuauuugaugauuacagauggcuccgcaucaggugugagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgacacguaucuggauacccccagaccugacgauggcuccaucacagggccaugugagagcaacggagacaaggguucgggcgggauuaaaggaggcuuugugcaucaaaggauggcaucuaagaucggucggugguacucccguacuaugucaaaaaccgagcgcauggggaugggccucuauguaaaguacgacggagaucccugggcugacagugaugcccuugcuuucagcggcguuaugauauccaugaaggaaccggggugguacucuuuuggauucgagauuaaagacaagaaaugcgaugugccuuguaucgguaucgaaaugguccacgacggcgggaaggagacauggcauagcgccgcaacugccauuuauugccugaugggaucaggccaguugcuaugggauaccgugacagguguggacauggcucuguga

SEQ ID NO: 150759 - RNA, 1401 nt, Artificial Sequence
  derived and/or modified sequence opt3 from neuraminidase__InfluenzaB__ACA96655
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcagggaauggacuuauaucgggguggacggaccggauagcaaugcacugcuuaagauuaaauacggugaggccuacaccgacacauaucacucuuacgcuaagaacauccugcggacucaagaauccgccuguaauugcauaggcggggauuguuauuugaugauuaccgacggacccgcaucaggcaucagcgagugccgcuuucucaaaauuagagaggguaggaucaucaaggaaauuuucccuacagggcggguuaagcacaccgaggaauguacgugcggauuugcuaguaacaaaacuauagagugugccugccgcgauaauucuuacacagcgaagcgaccauucgugaaacugaacgucgaaaccgacacugccgagaucagauuaaugugcacagagaccuaucuggauacgcccaggccuaaugacggcuccauuaccggcccaugugaaagcaacggggauaagggaucggguggcaucaaagggggauuugugcaucagcggauggcaucuaagauaggccguugguacucccgcacaaugucaaaaacuaagagaauggguauggggcucuauguaaaguacgacggcgaccccuggaccgauagugaggcucuugcccugagcggaguuaugguguccauggaggaaccgggcugguacucuuucggguuugaaauuaaagacaagaaaugcgaugucccuuguaucggaaucgagauggugcacgacgguggcaagacaacuuggcauagcgcugccaccgcaauuuauugcuugauggggucaggacagcuacugugggauacagugaccggcgucgacauggcccucuga

SEQ ID NO: 150760 - RNA, 1401 nt, Artificial Sequence
  derived and/or modified sequence opt3 from neuraminidase__InfluenzaB__ACA96666
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgagaggaccguaacaaacugagacaucuaaucagcgugaagcucggaaagauaccgacugucgaaaauuccaucuuccacauggcugccuggucaggcagugcgugccaugauggcaaagaguggaccuauauugggguggacggacccgauaacaaugcacugcuuaagaucaaauacggugaggccuacacagacacuuaucacagcuacgcuaacaagauucugaggacccaggaaucugccuguaauugcaucggcgggaacuguuauuugaugauaacagauggauccgcaucaggcguuagcgagugccgguuucucaaaauucgcgaggguagaaucauuaaggaaaucuucccuaccgggagggugaagcacacggaggaauguacuugcggauuugcuaguaauaaaacaaucgagugugccugccgggacaacucuuacaccgcgaagcgcccauucgucaaacugaauguggaaacugauacagccgagauucgauuaaugugcaccgacacguaucuggauacccccagaccugacgauggcuccauaacaggcccaugugagagcaacggggacaggggaucggguggcaucaaagggggauuuguacaucaacggauggcaucuaagauuggccguugguacucccgcacuaugucaaagaccgaaagaauggguauggggcucuauguuaaauacgacggcgaucccugggcugacagugaugcccuugcuuucagcggagugauggucuccaugaaggagccgggcugguacucuuuuggguucgaaaucaaggacaaaaagugcgaugugccuuguauaggaauugagauggugcacgacgaugguaaagaaacauggcauagcgccgcaacugccaucuauugccugaugggcucagggcaguugcuaugggacaccgucacaggaguugauauggcucuguga

SEQ ID NO: 150761 - RNA, 1401 nt, Artificial Sequence
  derived and/or modified sequence opt3 from neuraminidase__InfluenzaB__ACD56581
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaccaaaggaaauuccgcaccucuuauuauccgcgagccauucauugccugcgggcccaaggaauguaaacauuuugcuuugacgcacuacgcagcccagccuggcgguuauuacaacgggacucgagaggaccguaauaagcugagacaucuaaucagcgugaagcucggaaaaauaccaaccgucgagaacuccaucuuccacauggcugccuggucaggcagugcgugccaugauggcaaggaauggacauauauugggguggacggaccggauagcaaugcacugcuuaaaaucaaguacggugaggccuacacugacaccuaucacucuuacgcuaacaauauucugaggacacaggaauccgccuguaacugcaucggcgggaauuguuauuugaugauaaccgauggaucagcaagcggcauuagugagugccgguuucucaaaauccgcgaggguagaauuaucaaggaaaucuuccccacggggaggguuaagcacacugaggaauguacaugcggauuugcuucuaacaaaaccauugagugugccugccgggacaauuccuacacugcgaagcgcccuuucgugaaacugaacgucgaaacagauaccgccgagauacgauuaaugugcacggagaccuaucuggacacaccaagacccgaugacggcagcaucacuggcccuugugaaucgaaugggaacaagggaucugguggcauuaaagggggauuugugcaucaaaggauggcauccaagaucggccggugguacucacguaccaugaguaaaacaaagcgcauggguauggggcucuauguaaaguacgauggcgacccauggacugacagcgaugcucuugcccuguccggaguuauggugucuauggaggaacccggcugguacagcuucggguuugagauaaaagacaagaaaugcgaugucccguguauuggaaucgaaauggugcacgacgguggcaaggagaccuggcauucagcugccacagcaaucuauugcuugauggggaguggacagcuacugugggauaccgugacuggcgucgacauggcccucuga

SEQ ID NO: 150762 - RNA, 1401 nt, Artificial Sequence
  derived and/or modified sequence opt3 from neuraminidase__InfluenzaB__ACF33793
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauauacccagaccugacgauggcuccaucaccgggccaugugagagcaacggagacaaagguucgggcgggauuaagggaggcuuuguacaucaaaggauggcaucuaaaaucggucggugguacucccguacaaugucaaagacugagcgcauggggaugggccucuauguuaaauacgacggagaucccugggcugacagugaugcccuugcuuucagcggcgugauggucuccaugaaggaaccggggugguacucuuuuggauucgagauaaaggacaaaaagugcgaugugccuuguauugguaucgaaauggugcacgacggcgggaaagagaccuggcauagcgccgcaacagccaucuauugccugaugggaucaggccaguugcuaugggauacugucaccgguguugacauggcucuguga

SEQ ID NO: 150763 - RNA, 1401 nt, Artificial Sequence
  derived and/or modified sequence opt3 from neuraminidase__InfluenzaB__ACF33795
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccgaaaagauggggaugggccucuauguaaaguacgacggagagcccugggcugacagugaugcccuuacauucagcggcguuaugguguccauggaggaaccggggugguacucuuuuggauucgaaauaaaagacaagaaaugcgaugucccuuguauugguaucgagauggugcacgacggcgggaaggagacuuggcauagcgcugccaccgcaaucuauugccugaugggaucaggccaguugcuaugggauacagugaccggugucaacauggcccuguga

SEQ ID NO: 150764 - RNA, 1401 nt, Artificial Sequence
  derived and/or modified sequence opt3 from neuraminidase__InfluenzaB__ACF33797
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauacccugaggacacaggagucugccuguaacugcauugggggaaauuguuauuugaugaucaccgauggcuccgcaucagguguuagcgaaugccgguuucucaagauacgcgaggggagaauuaucaaagagauuuucccuacgggaagggugaagcacacugaagaguguacaugcggcuuugcuaguaacaagaccaucgaaugugccugccgggacaauucuuacacugcgaaacgcccauucgucaagcugaacguggagacagauaccgccgaaauccgauuaaugugcacggagaccuaucuggacacacccagaccugaugacggcuccauuacugggccaugugagagcaacggagauaaagguucgggcgggauaaagggaggcuuuguacaucaaaggauggcaucuaaaaucggucggugguacucccguaccaugucaaagacagaacgcauggggaugggccucuauguuaaauacgacggagaccccugggcugauagugacgcccuugcucugauuggcgugauggucagcauggaggaaccggggugguacuccuucggauuugagaucaaggauaagaaaugcgacgugccuuguauagguauugaaauggugcacgauggcgggaaggagacuuggcauucugccgcaaccgccaucuauugcuugaugggaagcggccagcuacugugggacacagucaccgguguuaauauggcucucuga

SEQ ID NO: 150765 - RNA, 1401 nt, Artificial Sequence; identical to SEQ ID NO: 150744
  derived and/or modified sequence opt3 from neuraminidase__InfluenzaB__ACF41662

SEQ ID NO: 150766 - RNA, 1401 nt, Artificial Sequence
  derived and/or modified sequence opt3 from neuraminidase__InfluenzaB__ACF54140
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgaaaggagaccgaaacaagcugcgucaucuaaucagcgugaagcucggcaaaauaccgacugucgaaaauuccaucuuccacauggcugccuggucaggcagugcgugccaugaugggaaggaguggaccuauauuggaguggacggucccgauaacaaugcacugcuuaaaaucaaguacggcgaggccuacacagacacuuaucacagcuacgcuaacaaaauucugagaacccaggagucugccuguaauugcaucgggggaaacuguuauuugaugauaacagauggcuccgcaucagguguuagcgaaugcagguuucucaagauucgggaggggcgcaucauuaaggagaucuucccuaccggaagagugaaacacacggaagaguguacuugcggcuuugcuaguaauaagacaaucgaaugugccugcagggacaacucuuacaccgcgaaacggccauucgucaagcugaauguggagacugauacagccgaaauucgcuuaaugugcaccgacacguaucuggauacaccccgaccugacgauggcuccauaaccgggccaugugagagcaacggagacagagguucgggcgggaucaaaggaggcuuuguacaucaaaggauggcaucuaagauuggucggugguacucccguacuaugucaaaaaccgagcgcauggggaugggccucuauguuaaguacgacggagaucccugggcugacagugaugcccuugcuuucagcggcgugauggucuccaugaaggaaccggggugguacucuuuuggauucgagaucaaagacaagaaaugcgaugugccuuguauagguauugaaauggugcacgacggcgggaaggagacauggcauagcgccgcaacugccaucuauugccugaugggaucaggccaguugcuaugggauaccgucacagguguugacauggcucuguga

SEQ ID NO: 150767 - RNA, 1401 nt, Artificial Sequence
  derived and/or modified sequence opt3 from neuraminidase__InfluenzaB__ACF54151
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggaaaucguaacaagcugagacaucuaaucagcgugaagcucggcaaaauaccgacugucgaaaauuccaucuuccacauggcugccuggucaggcagugcgugccaugacgggaaggaguggaccuauauuggaguggauggucccgacaacaaugcacugcuuaaaaucaaguacggcgaagccuacacagauacuuaucacagcuacgcuaacaauauucugaggacccaggagucugccuguaacugcaucgggggaaauuguuauuugaugauaacagacggcuccgcaucagguguuagcgaaugccgguuucucaaaauucgcgaggggagaaucauuaaggagaucuucccuaccggaaggaucaagcacacggaagaguguacuugcggcuuugcuaguaacaaaacaauugaaugugccugccgggauaauucuuacaccgcgaagcgcccauucgugaaacugaacgucgagacugacacagccgaaauacgauuaaugugcaccgagacguaucuggauacccccagaccugacgauggcuccaucacagggccaugugagagcaacggagacaaggguucgggcgggauuaaaggaggcuuugugcaucaaaggauggcaucuaagaucggucggugguacucccguacuaugucaaaaaccaagcgcauggggaugggccucuauguaaaguacgauggagaccccugggcugacagugaugcccuugcuuucagcggcguuaugguguccauggaggagccggggugguacucuuuuggauucgaaauaaaagacaagaaaugcgaugucccuuguauugguaucgagauggugcacgacggcgggaaggaaacauggcauagcgccgcaacugccaucuauugccugaugggaucaggccaguugcuaugggauaccgugacaggugucaauauggcucuguga

SEQ ID NO: 150768 - RNA, 1401 nt, Artificial Sequence
  derived and/or modified sequence opt3 from neuraminidase__InfluenzaB__ACF54162
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcaaggaauggacuuauaucgggguggacggaccggauagcaaugcacugcuuaaaauuaaguacggugaggccuacaccgacacauaucacucuuacgcuaaaaacauccugaggacucaagaauccgccuguaauugcauaggcggggauuguuauuugaugauuaccgacggacccgcaucaggcaucagcgagugccgguuucucaagauucgcgaggguagaaucaucaaggaaauuuucccuacagggaggguuaaacacaccgaggaauguacgugcggauuugcuaguaacaagacuauagagugugccugccgggauaauaacuacacagcgaaacgcccauucgugaagcugaaugucgaaaccgacacugccgagauccgauuaaugugcacagagaccuaucuggauacgcccagaccuaacgacggcucuauuaccggcccaugugaauccgauggggacaaaggaagcgguggcaucaaagggggauuugugcaucagaggauggcaucgaagauaggccggugguacucucguacaauguccaagacuaagcgcauggguauggagcucuauguaaaauacgacggggaucccuggaccgacucagaagcucuugcccugaguggcguuauggugagcauggaggaaccgggaugguacuccuucggcuuugagauuaaggauaaaaagugcgacgucccuuguaucgggaucgagauggugcacgauggagguaaaacaacuuggcauucugcugccaccgcaauuuauugcuugaugggcagcgggcagcuacugugggacacagugaccggagucgauauggcccucuga

SEQ ID NO: 150769 - RNA, 1401 nt, Artificial Sequence
  derived and/or modified sequence opt3 from neuraminidase__InfluenzaB__ACF54184
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaccaaaggcaauuccgcaccucuuauuauccgcgagccauucauugccugcggacccaaggaauguaaacauuuugcuuugacgcacuacgcagcccagccuggcgguuauuacaacgggacuaaggaggaccgaaauaagcugcgucaucuaaucagcgugaaacucggaaagauaccaaccgucgagaacuccaucuuccacauggcugccuggucaggcagugcgugccaugauggcaaagaauggacauauauugggguggacggaccggauagcaaugcacugcuuaagaucaaauacggugaggccuacacugacaccuaucacucuuacgcuaacaauauucugagaacacaggaauccgccuguaacugcaucggcgggaauuguuauuugaugauaaccgauggaucagcaagcggcauuagugagugcagguuucucaagauccgggagggucgcauuaucaaggaaaucuuccccacggggagaguuaaacacacugaggaauguacaugcggauuugcuucuaacaagaccauugagugugccugcagggacaauuccuacacugcgaaacggccuuucgugaagcugaacgucgaaacagauaccgccgagauacgcuuaaugugcacggagaccuaucuggacacaccacgacccgaugacggcagcaucacuggcccuugugaaucgaaugggaacaaaggaucugguggcauuaaagggggauuugugcaucaaagaauggcauccaagaucgggaggugguacucacggaccaugaguaagacaaagcguauggguauggggcucuauguaaaauacgauggcgacccauggacugacagcgaugcucuugcccuguccggaguuauggugucuauggaggaacccggcugguacagcuucggguuugagauaaaggacaaaaagugcgaugucccguguauuggaaucgaaauggugcacgacgguggcaaagagaccuggcauucagcugccacagcaaucuauugcuugauggggaguggacagcuacugugggauaccgugacuggcgucgacauggcccucuga

SEQ ID NO: 150770 - RNA, 1401 nt, Artificial Sequence
  derived and/or modified sequence opt3 from neuraminidase__InfluenzaB__ACF54206
augcugcccagcaccauccagacacucacucuuuuccugacguccggcgggguguuguuaucucuguacgucucagccagucuaagcuaucuccuguacuccgacauucuucugaaguuuucuaccacagagacuaccgcuccuacaaugccauuggauugcgcaaacgccucgaauguucaagcggugaacagaucagcuaccaaaggaguaacucuccugcugccggaacccgaguggacauauccuaggcucagcuguccagguaguaccuuccagaaggccuuacugauaucuccccaccgguuuggcgaaacgaaaggaaauuccgcaccucuuaucauucgcgagccauucaucgccugcgggcccaaggaauguaaacauuuugcuuugacucacuacgcagcccagccuggcgguuauuacaacgggacccgagaggaccguaauaagcugagacaucuaauuagcgugaagcucggaaaaaucccaacagucgagaacuccauauuccacauggcugccuggucaggcagugcgugccaugauggcaaggaauggacuuauaucgggguggacggaccggauagcaaugcacugcuuaaaauuaaguacggugaggccuacaccgacacauaucacucuuacgcuaacaauauccugaggacccaggaauccgccuguaacugcauuggcgggaauuguuauuugaugaucacggauggaucagcaagcggcauaagugagugccgguuucucaaaauucgcgaggguagaaucauuaaggaaaucuuccccacugggaggguuaagcacacagaggaauguaccugcggauuugcuucuaacaaaacuaucgagugugccugccgggacaauuccuacacagcgaagcgcccuuucgugaaacugaacgucgaaaccgauacggccgagauucgauuaaugugcaccgagacauaucuggacacuccaagacccgaugacggcagcauaaccggcccuugugaaucgaaugggaacaagggaucugguggcaucaaagggggauuugugcaucaaaggauggcauccaagauuggccggugguacucacguacaaugaguaaaacuaagcgcauggguauggggcucuauguaaaguacgauggcgacccauggaccgacagcgaugcucuugcccuguccggaguuauggugucuauggaggaacccggcugguacagcuucggguuugagaucaaagacaagaaaugcgaugucccguguauaggaauugaaauggugcacgacgguggcaaggagacauggcauucagcugccaccgcaaucuauugcuugauggggaguggacagcuacugugggauacugugacgggcgucgacauggcccucuga

SEQ ID NO: 150771 - RNA, 1401 nt, Artificial Sequence
  derived and/or modified sequence opt3 from neuraminidase__InfluenzaB__ACF54217
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcuacuaaaggaguaacccuccugcugccggaacccgaguggacauauccuagacucagcuguccagguaguaccuuccagaaggccuuacugauuucuccccauagguuuggcgaaacuaaaggaaauuccgcaccucuuaucauucgggagccauucaucgccugcgggcccaaggaauguaaacacuuugcuuugacacauuacgcagcccagccuggcgguuauuacaacgggacccgcgaggaccgaaauaagcugcgucaccuaauaagcgugaagcucggaaaaaucccaacggucgagaacuccauuuuccauauggcugccuggucaggcagugcgugccacgauggcagagaauggacuuauaucgggguggacggaccggauagcaaugcacugcuuaagauuaaauacggugaggccuacaccgacacauaucacucuuacgcuaagaacauccugaggacucaagaauccgccuguaauugcauaggcggggauuguuauuugaugauuaccgacggacccgcaucaggcaucagcgagugccgguuucucaaaauucgcgaggguagaaucaucaaggaaauuuucccuacagggaggguuaagcauaccgaggaauguacgugcggauuugcuaguaacaaaacuauagagugugccugccgggauaauucuuacacagcgaagcgcccauucgugaaacugaacgucgaaaccgacacugccgagauccgauuaaugugcacagagaccuaucuggauacgcccagaccuaaugacggcuccauuaccggcccaugugaaagcaacggggauaagggaucggguggcaucaaagggggauuugugcaccagaggauggcaucuaagauaggccggugguacucccguacaaugucaaaaacuaagcgcauggguauggggcucuauguaaaguacgacggcgaccccuggaccgauagugaggcucuugcccugagcggaguuaugguguccauggaggaaccgggcugguacucuuucggguuugaaauuaaagacaagaaaugcgaugucccuuguaucggaaucgagauggugcaugacgguggcaagacaacuuggcacagcgcugccaccgcaauuuauugcuugauggggucaggacagcuacugugggauacagugaccggcgucgacauggcccucuga

SEQ ID NO: 150772 - RNA, 1401 nt, Artificial Sequence; identical to SEQ ID NO: 150663
  derived and/or modified sequence opt3 from neuraminidase__InfluenzaB__ACF54228

SEQ ID NO: 150773 - RNA, 1401 nt, Artificial Sequence; identical to SEQ ID NO: 150684
  derived and/or modified sequence opt3 from neuraminidase__InfluenzaB__ACF54239

SEQ ID NO: 150774 - RNA, 1401 nt, Artificial Sequence
  derived and/or modified sequence opt3 from neuraminidase__InfluenzaB__ACF54261
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuagugagcgucaagcucggaaaaaucccgacuguggagaacuccauauuccacauggcugccuggucaggcagugcgugccaugauggcaaggaauggaccuauaucgggguugacggacccgauagcaaugcacugcuuaaaauuaaguacggugaggccuacacagacacuuaucacucuuacgcuaacaauauccugaggacccaggaauccgccuguaacugcauuggcgggaauuguuauuugaugaucacagauggaucagcaagcggcauaagugagugccgguuucucaaaauucgcgaggguagaaucauuaaggaaaucuucccuaccgggagggugaagcacacggaggaauguacuugcggauuugcuucuaacaaaacaaucgagugugccugccgggacaauuccuacaccgcgaagcgcccauucgucaaacugaacguggaaacugauacagccgagauucgauuaaugugcaccgagacguaucuggacacccccagaccugaugacggcagcauaacaggcccaugugaaucgaauggggauaagggaucugguggcaucaaagggggauuuguacaucaaaggauggcauccaagauuggccggugguacucacguacuaugaguaaaaccaagcgcauggguauggggcucuauguuaaguacgacggcgaccccuggacagauagcgacgcucuugcccuguccggagugauggucucuauggaggaaccgggcugguacagcuucggguuugagaucaaagauaagaaaugcgacgugccuuguauaggaauugaaauggugcacgaugguggcaaggagacuuggcauucagcugccaccgcaaucuauugcuugauggggaguggacagcuacugugggacacagucaccggcguugauauggcccucuga

SEQ ID NO: 150775 - RNA, 1401 nt, Artificial Sequence
  derived and/or modified sequence opt3 from neuraminidase__InfluenzaB__ACF54272
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaccaaaggaaauuccgcaccucuuauuauccgcgagccauucauugccugcgggcccaaggaauguaaacauuuugcuuugacgcacuacgcagcccagccuggcgguuauuacaacgggacucgagaggaccguaauaagcugagacaucuaaucagcgugaagcucggaaaaauaccaaccgucgagaacuccaucuuccacauggcugccuggucaggcagugcgugccaugauggcaaggaauggacauauauugggguggacggaccggauagcaaugcacugcuuaaaaucaaguacggugaggccuacacugacaccuaucacucuuacgcuaacaauauucugaggacacaggaauccgccuguaacugcaucggcgggaauuguuauuugaugauaaccgauggaucagcaagcggcauuagugagugccgguuucucaaaauccgcgaggguagaauuaucaaggaaaucuuccccacggggaggguuaagcacacugaggaauguacaugcggauuugcuucuaacaaaaccauugagugugccugccgggacaauuccuacacugcgaagcgcccuuucgugaaacugaacgucgaaacagauaccgccgagauacgauuaaugugcacggagaccuaucuggacacaccaagacccgaugacggcagcaucacuggcccuugugaaucgaauggggauaagggaucugguggcauuaaagggggauuugugcaucaaaggauggcauccaagaucggccggugguacucacguaccaugaguaaaacaaagcgcauggguauggggcucuauguaaaguacgacggcgacccauggacugauagcgacgcucuugcccuguccggaguuauggugucuauggaggaacccggcugguacagcuucggguuugagauaaaagauaagaaaugcgacgucccguguauuggaaucgaaauggugcacgaugguggcaaggagaccuggcauucagcugccacagcaaucuauugcuugauggggaguggacagcuacugugggacaccgugacuggcgucgauauggcccucuga

SEQ ID NO: 150776 - RNA, 1401 nt, Artificial Sequence
  derived and/or modified sequence opt3 from neuraminidase__InfluenzaB__ACF54283
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaccaaaggaaauuccgcaccucuuauuauccgcgagccauucauugccugcgggcccaaggaauguaaacauuuugcuuugacgcacuacgcagcccagccuggcgguuauuacaacgggacucgagaggaccguaauaagcugagacaucuagugagcgucaagcucggaaaaaucccaaccguggagaacuccauauuccacauggcugccuggucaggcagugcgugccaugauggcaaggaauggacauauaucgggguugacggaccggauagcaaugcacugcuuaaaauuaaguacggugaggccuacacugacaccuaucacucuuacgcuaacaauauccugaggacacaggaauccgccuguaacugcauuggcgggaauuguuauuugaugaucaccgauggaucagcaagcggcauaagugagugccgguuucucaaaauucgcgaggguagaaucauuaaggaaaucuuccccacggggagggugaagcacacugaggaauguacaugcggauuugcuucuaacaaaaccaucgagugugccugccgggacaauuccuacacugcgaagcgcccuuucgucaaacugaacguggaaacagauaccgccgagauucgauuaaugugcacggagaccuaucuggacacaccaagacccgaugacggcagcauaacuggcccuugugaaucgaauggggauaagggaucugguggcaucaaagggggauuuguacaucaaaggauggcauccaagauuggccggugguacucacguaccaugaguaaaacaaagcgcauggguauggggcucuauguuaaguacgacggcgacccauggacugauagcgacgcucuugcccuguccggagugauggucucuauggaggaacccggcugguacagcuucggguuugagaucaaagauaagaaaugcgacgugccguguauaggaauugaaauggugcacgaugguggcaaggagaccuggcauucagcugccacagcaaucuauugcuugauggggaguggacagcuacugugggacaccgucacuggcguugauauggcccucuga

SEQ ID NO: 150777 - RNA, 1401 nt, Artificial Sequence
  derived and/or modified sequence opt3 from neuraminidase__InfluenzaB__ACF54294
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaucccauuggauugcgcaaacgccucgaauguucaagcggugaacagaucagcuacaaaaggaguaaccuuccuccugccggaacccgaguggacuuauccuaggcugagcuguccagguaguacauuucagaaggcccucuuaauuucuccccaccgguucggcgaaaccaaaggaaauuccgcaccucugaucauucgcgagccauuuaucgccugcgggcccaaggaauguaaacauuucgcucuuacgcacuacgcagcccagccuggcgguuauuacaacgggacucgagaggaccguaauaaguugagacaucugauaagcgugaagcuaggaaaaaucccaaccgucgagaacuccauuuuucacauggcugccuggucaggcagugcgugccaugauggcaaggaauggacauauaucgggguggacggaccggauagcaaugcacuccugaaaauuaaguacggugaggccuacacugacaccuaucacucuuacgcuaacaauauccuuaggacacaggaauccgccuguaacugcauaggcgggaauuguuaucugaugauuaccgauggaucagcaagcggcaucagugagugccgguucuugaaaauucgcgaggguagaaucaucaaggaaauuuuucccacggggaggguuaagcacacugaggaauguacaugcggauucgcuucuaacaaaaccauagagugugccugccgggacaauuccuacacugcgaagcgcccuuuugugaaacucaacgucgaaacagauaccgccgagauccgacugaugugcacggagaccuauuuagacacaccaagacccgaugacggcagcauuacuggcccuugugaaucgaaugggaacaagggaucugguggcaucaaagggggauucgugcaucaaaggauggcauccaagauaggccggugguacucacguaccaugaguaaaacaaagcgcauggguauggggcuguauguaaaguacgauggcgacccauggacugacagcgaugcucucgcccuuuccggaguuauggugucuauggaggaacccggcugguacagcuuuggguucgagauuaaagacaagaaaugcgaugucccguguaucggaaucgaaauggugcacgacgguggcaaggagaccuggcauucagcugccacagcaauuuauugccugauggggaguggacaguugcuaugggauaccgugacuggcgucgacauggcccuguga

SEQ ID NO: 150778 - RNA, 1401 nt, Artificial Sequence
  derived and/or modified sequence opt3 from neuraminidase__InfluenzaB__ACF54305
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaaccuuccuccugccggaacccgaguggacuuauccuaggcugagcuguccagguaguacauuucagaaggcccucuuaaucucuccccaccgguucggcgaaaccaaaggaaauuccgcaccucugauuauccgcgagccauuuauugccugcgggcccaaggaauguaaacauuucgcucuuacgcacuacgcagcccagccuggcgguuauuacaacgggacucgagaggaccguaauaaguugagacaucugaucagcguggagcuaggaaagauaccaaccgucgaaaacuccaucuuucacauggcugccuggucaggcagugcgugccaugauggcaaagaguggacauauauugggguggacggaccggauagcaaugcacuccugaagaucaaauacggugaagccuacacugacaccuaucacucuuacgcuaacaauauucuuaggacacaggaguccgccuguaacugcaucggcgggaauuguuaucugaugauaaccgauggaucagcaagcggcauuagugagugccgguucuugaagauccgcgaagguagaauuaucaaagagaucuuucccacggggaggguuaagcacacugaagaguguacaugcggauucgcuucuaacaagaccauugaaugugccugccgggacaauuccuacacugcgaaacgcccuuuugugaagcucaacgucgagacagauaccgccgagauacgacugaugugcacggaaaccuauuuagacacaccaagacccgaugacggcagcaucacuggcccuugugagucgaaugggaacaaaggaucugguggcauuaaagggggauucgugcaucaaaggauggcauccaagaucggccggugguacucacguaccaugaguaagacaaaacgcauggguauggggcuguauguaaaguacgauggcgacccauggacugacagcgaugcucucgcccuuuccggaguuauggugucuauggaggaacccggcugguacagcuuuggguucgaaauaaaggacaaaaagugcgaugucccguguauuggaaucgagauggugcacgacgguggcaaagagaccuggcauucagcugccacagcaaucuauugccugauggggaguggacaguugcuaugggauaccgugacuggcgucgacauggcccuguga

SEQ ID NO: 150779 - RNA, 1401 nt, Artificial Sequence
  derived and/or modified sequence opt3 from neuraminidase__InfluenzaB__ACF54316
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgagacguaucuggacacccccagaccugaugacggcuccauaacagggccaugugagagcaacggagauaaagguucgggcgggaucaagggaggcuuuguacaucaaaggauggcaucuaaaauuggucggugguacucccguacuaugucaaagaccgaacgcauggggaugggccucuauguuaaauacgacggagaccccugggcugauagugacgcccuugcucugaucggcgugauggucagcauggaggaaccggggugguacuccuucggauuugagauaaaggauaagaauugcgacgugccuuguauugguaucgaaauggugcacgauggcgggaaagagacauggcauucugccgcaacugccaucuauugcuugaugggaagcggccagcuacugugggacaccgucacagguguuaacauggcucucuga

SEQ ID NO: 150780 - RNA, 1404 nt, Artificial Sequence
  derived and/or modified sequence opt3 from neuraminidase__InfluenzaB__ACF54338
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcuccccgaaccugaguggaccuauccaagguuaagcugucccgguaguacuuuccagaaggcccugcuuaucuccccucaccgguuuggcgaaacaaaaggaaauucugcaccauugauuauccgcgagcccuucauugccugcgggccuaaggaauguaaacauuuugcucugacccacuacgcagcccagccaggcgguuauuacaacgggacgcgaggagaccguaauaagcuaagacaucucaucagcgugaagcugggcaaaauaccgacugucgagaacuccaucuuccacauggcugccuggucaggcagugcgugccaugaugggaaggaguggaccuauauuggaguggacggucccgauaauaacgcacuucugaaaaucaaguacggcgaagccuacacagacacuuaucacagcuacgcuaauaacauuuugaggacccaggagucugccuguaauugcaucgggggaaacuguuaucucaugauaacagauggcuccgcaucagguguuagcgaaugccgguuucugaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaauuaaaugucgagacugauacagccgaaauacgacugaugugcaccgagacguaucucgacacccccagaccugaugacggcuccaucacagggccaugugagagcaacggagguaagggcucugggggaauuaaaggcgguuuugugcaucaaaggauggcaucgaagaucgggcggugguacucccguacuaugucaaaaaccgaacgcaagggcaugggacuuuauguaaaguacgauggcgaccccugggcugacagugaugcccugguuuucagcggggugauggucuccauggaggaaccgggaugguacucuuuugguuucgagauaaaagacaagaaaugcgaugugccuuguauuggcaucgaaauggugcacgacgggggaaaggagacauggcauagcgcugccacugcaaucuauugcuugaugggcucaggucagcuacugugggauaccgucacagggguuaacauggcccucuga

SEQ ID NO: 150781 - RNA, 1401 nt, Artificial Sequence
  derived and/or modified sequence opt3 from neuraminidase__InfluenzaB__ACF54349
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuaauccccaccgguuuggcgaaaccaaagggaacuccgccccucuuaucauucgcgagccauucaucgcuugcggacccacugaauguaagcauuuugcauugacacacuacgccgcucagccuggcgguuauuacaaugggacccgagaggaccguaacaaacugagacaucuaauaucugugaagcucggaaagaucccaacggucgagaauagcauuuuccacauggccgcgugguccggcucagcaugccaugauggcaaagaauggacuuauaucgggguggacggaccggauaguaacgcccugcuuaagauuaaauacggugaggcuuacaccgacacauaucacagcuacgccaagaauauccugaggacucaagaaucugcauguaacugcauaggcggggauuguuauuugaugauuaccgacggauccgcuucaggcaucagcgagugccgguuucucaaaauucgcgaggguagaaucaucaaggaaauuuuccccacagggaggguuaagcacaccgaggaauguacgugcggauuugccaguaauaaaacuauagagugugcgugccgggauaacucuuacacagccaagcgcccuuucgugaaacugaaugucgaaaccgacacugcagagauccgauuaaugugcacagagaccuaucuggauacgccaagacccaacgacggcuccauuaccggcccuugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgauccauggaccgacagugaggcccuugcucugagcggaguuaugguguccauggaggaacccggcugguacucuuucggguuugaaauuaaagauaagaaaugcgacgucccguguaucggaaucgagauggugcacgaugguggcaagacaacuuggcauagcgccgcaaccgccauuuauugcuugauggggucaggacagcuacugugggacacagugaccggcgucgauauggcucucuga

SEQ ID NO: 150782 - RNA, 1401 nt, Artificial Sequence
  derived and/or modified sequence opt3 from neuraminidase__InfluenzaB__ACF54371
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugguguccauggaggaaccgggcugguacucuuucggguuugaaauuaaagauaagaaaugcgacgucccuuguaucggaaucgagauggugcacgaugguggcaagacaacuuggcauagcgccgcaaccgccauuuauugcuugacagggucaggacagcuacugugggacaccgugacuggcgucgauauggcucucuga

SEQ ID NO: 150783 - RNA, 1401 nt, Artificial Sequence
  derived and/or modified sequence opt3 from neuraminidase__InfluenzaB__ACI22549
augcugcccagcaccauccagacacucacucuuuuccugacguccggcgggguguuguuaucucuguacgucucagccagucuaagcuaucuccuguacuccgacauucuucugaaguuuucuccuaccgagauaacagcuagaacuaugccauuggauugcgcaaacgccucgaauguucaagcggugaacaggucagcuaccaaaggaguaacacuccugcugccggaacccgaguggaccuauccucggcucagcuguccagguaguacuuuccagaaggccuuacugaucucuccccaccgcuuuggcgaaacaaaaggaaauuccgcaccucuuauuauccgagagccauucauugccugcgggcccaacgaauguaagcauuuugcuuugacccacuacgcagcccagccuggcgguuauuacaaugggacgcguggagacagaaacaaacugaggcaucuaaucagcgugaagcucggcaagauaccaacugucgaggauuccaucuuccacauggcugccuggucaggcagugcgugccaugacgggaaagaguggaccuauauuggaguggaugguccggacaauaacgcacugcuuaagaucaaauacggcgaagccuacacagauacuuaucacagcuacgcuaauaacauucugcggacccaggagucugccuguaauugcaucgggggaaacuguuauuugaugauaacagacggcuccgcaucagguguuagcgaaugccgcuuucucaagauuagagaggggaggaucauuaaagagaucuuccccaccggacgggugaagcacacggaagaguguacuugcggcuuugcuaguaauaagacaaucgaaugugccugccgcgauaacucuuacaccgcgaaacgaccuuucgucaagcugaauguggagacugacacagccgaaauuagauuaaugugcaccgagacguaucuggauaccccaaggcccgacgauggcuccauaacagggccuugugagagcaacggagacaaagguucgggcgggaucaagggaggcuuuguacaucaacggauggcaucuaaaauuggucguugguacucccgcacuaugucaaagaccgaaagaauggggaugggccucuauguuaaauacgacggagauccaugggcugacagugaugcccuugcucugaucggcgugauggucagcauggaggaacccgggugguacuccuucggauuugagauaaaggacaagaacugcgaugugccguguauugguaucgaaauggugcacgacggcgggaaagagacauggcauucugccgcaacugccaucuauugcuugaugggaagcggccagcuacugugggauaccgucacagguguuaauauggcucucuga

SEQ ID NO: 150784 - RNA, 1401 nt, Artificial Sequence
  derived and/or modified sequence opt3 from neuraminidase__InfluenzaB__ACI22551
augcugcccagcaccauccagacacucacucuuuuccugacguccggcgggguguuguuaucucuguacgucucagccagucuaagcuaucuccuguacuccgacauucuucugaaguuuucuccuaccgagauaacagcuuugacuaugccacucgauugcgcaaacgccucgaauguucaagcggugaacagaucagcuaccaaaggaguaacacugcugcucccggaacccgaguggaccuauccuagguuaagcuguccagguaguacuuuccagaaggcccugcuuaucucuccccaccgguuuggcgaaacaaaaggaaauuccgcaccuuugauuauccgcgagccauucauugccugcgggcccaacgaauguaagcauuuugcucugacccacuacgcagcccagccuggcgguuauuacaaugggacgcgaggagaccguaacaaacuaagacaucucaucagcgugaagcugggcaagauaccaacugucgaaaauuccaucuuccacauggcugccuggucaggcagugcgugccaugaugggaaagaguggaccuauauuggaguggacgguccggauaacaaugcacuucugaagaucaaauacggcgaggccuacacagacacuuaucacagcuacgcuaacaauauuuugaggacccaggagucugccuguaacugcaucgggggaaauuguuaucucaugauaacagauggcuccgcaucagguguuagcgaaugccgguuucugaagauucgcgaggggagaaucauuaaagagaucuuccccaccggaagggugaagcacacggaagaguguacuugcggcuuugcuaguaacaagacaaucgaaugugccugccgggacaauucuuacaccgcgaaacgcccuuucgucaaguuaaacguggagacugauacagccgaaauucgacugaugugcaccgagacguaucucgacaccccaagacccgaugacggcuccauaacagggccuugugagagcaacggagauaaagguucgggcgggaucaagggaggcuuuguacaucaaaggauggcaucuaaaauuggucggugguacucccguacuaugucaaagaccgaacgcauggggaugggccuuuauguuaaauacgacggagacccaugggcugauagugacgcccuggcuuugaucggcgugauggucagcauggaggaacccgggugguacuccuucggauuugagauaaaggauaagaauugcgacgugccguguauugguaucgaaauggugcacgauggcgggaaagagacauggcauucugccgcaacugccaucuauugccuaaugggaagcggccagcugcucugggacaccgucacagguguuaacauggcucuguga

SEQ ID NO: 150785 - RNA, 1401 nt, Artificial Sequence; identical to SEQ ID NO: 150784
  derived and/or modified sequence opt3 from neuraminidase__InfluenzaB__ACI22555

SEQ ID NO: 150786 - RNA, 1401 nt, Artificial Sequence; identical to SEQ ID NO: 150651
  derived and/or modified sequence opt3 from neuraminidase__InfluenzaB__ACI22557

SEQ ID NO: 150787 - RNA, 1401 nt, Artificial Sequence
  derived and/or modified sequence opt3 from neuraminidase__InfluenzaB__ACI22559
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaaccucucagcuaccaaaggaguaacacugcugcuccccgaaccugaguggaccuauccaagauuaagcugucccgguaguacuuuccagaaggcccugcuuaucuccccucacagguuuggcgaaacaaaaggaaauucugcaccauugauuauccgggagcccuucauugccugcgggccuaaggaauguaaacauuuugcucugacccacuacgcagcccagccaggcgguuauuacaacgggacgcgcggagaccgaaauaagcuacgucaucucaucagcgugaagcugggcaaaauaccgacugucgagaacuccaucuuccacauggcugccuggucaggcagugcgugccaugaugggaaggaguggaccuauauuggaguggacggucccgauaauaacgcacuucugaaaaucaaguacggcgaagccuacacagacacuuaucacagcuacgcuaauaacauuuugagaacccaggagucugccuguaauugcaucgggggaaacuguuaucucaugauaacagauggcuccgcaucagguguuagcgaaugcagguuucugaaaauucgggaggggcgcaucauuaaggagaucuucccuaccggaagaaucaagcacacggaagaguguacuugcggcuuugcuaguaauaaaacaauugaaugugccugcagggacaacucuuacaccgcgaagcggccauucgugaaauuaaaugucgagacugauacagccgaaauacgccugaugugcaccgagacguaucucgacacaccccgaccugaugacggcuccaucaccgggccaugugagagcaacggagguaagggcucugggggaauuaaaggcgguuuugugcaucaaagaauggcaucgaagaucgggaggugguacucccggacuaugucaaaaaccgaacguaagggcaugggacuuuauguaaaguacgauggcgaccccugggcugacagugaugcccuggcuuucagcgggguuaugguguccauggaggaaccgggaugguacucuuuugguuucgagauaaaagacaagaaaugcgaugucccuuguauuggcaucgaaauggugcacgacgggggaaaggagacauggcauagcgccgcaacugccaucuauugcuugaugggcucaggucagcuacugugggauaccgugacaggggucaacauggcucucuga

SEQ ID NO: 150788 - RNA, 1401 nt, Artificial Sequence
  derived and/or modified sequence opt3 from neuraminidase__InfluenzaB__ACI22561
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggagguacacuccugcugcccgaaccugaguggaccuauccaaggcucagcugucccggcaguacuuuccagaaggccuuacugaucuccccucaccgguuuggggaaacaaaaggaaauucugcaccacuuauuauccgcgagcccuucauugccugcggcccuaacgaauguaagcauuuugcuuugacccacuacgcagcccagccagguggguauuacaauggaacgcgaggcgaccguaacaaacugagacaucuaaucagcguaaagcucggcaagauaccgacuguggaaaauuccaucuuccacauggcugccuggucagggagugcgugccaugauggaaaagaguggaccuauauuggugucgacggccccgauaacaaugcacugcuuaagaucaaauacggggaggccuacacagacacuuaucacagcuacgcuaacaagauucugaggacccaggagucugccuguaauugcaucggaggcaacuguuauuugaugauaacagaugguuccgcaucaggggugagcgaaugccgguuucucaaaauucgcgagggaagaaucauuaaggagaucuucccuaccggcaggguuaagcacacggaagaguguacuugcggcuuugcuaguaauaaaacaaucgaaugugccugccgggacaacucuuacaccgcgaagcgcccauucgugaaacugaaugucgagacugauacagccgaaauucgauuaaugugcaccgacacguaucuggauacccccagaccugacgauggguccauaacaggaccaugugagagcaacggugacaagggcucugggggaaucaaaggcgguuuugugcaucaaaggauggcaucgaagauugggcggugguacucccguacuaugucaaaaaccgagcgcaugggcaugggacucuauguaaaguacgacggcgaucccugggcugacagugaugcccuugcuuucagcgggguuaugguguccaugaaggaaccgggaugguacucuuuugguuucgagaucaaagacaagaaaugcgaugucccuuguauaggcauugaaauggugcacgacgggggaaaggagacauggcauagcgccgcaacugccaucuauugccugaugggcucaggucaguugcuaugggauaccgugacaggggucgacauggcucuguga

SEQ ID NO: 150789 - RNA, 1401 nt, Artificial Sequence; identical to SEQ ID NO: 150651
  derived and/or modified sequence opt3 from neuraminidase__InfluenzaB__ACI22563

SEQ ID NO: 150790 - RNA, 1401 nt, Artificial Sequence
  derived and/or modified sequence opt3 from neuraminidase__InfluenzaB__ACI22565
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaaggaauguaaacacuuugcuuugacccauuacgcagcccagccaggcgguuauuacaacgggacgcgcggagaccgaaauaagcugcgucaccuaaucagcgugaagcucggcaaaauaccgacugucgagaacuccaucuuccauauggcugccuggucaggcagugcgugccacgaugggaaggaguggaccuauauuggaguggacggucccgauaauaacgcacugcuuaaaaucaaguacggcgaagccuacacagacacuuaucacagcuacgcuaauaacauucugagaacccaggagucugccuguaauugcaucgggggaaacuguuauuugaugauaacagauggcuccgcaucagguguuagcgaaugcagguuucucaaaauucgggaggggcgcaucauuaaggagaucuucccuaccggaagaaucaagcauacggaagaguguacuugcggcuuugcuaguaauaaaacaauugaaugugccugcagggacaacucuuacaccgcgaagcggccauucgugaaacugaaugucgagacugauacagccgaaauacgcuuaaugugcaccgagacguaucuggacacaccccgaccugaugacggcuccaucaccgggccaugugagagcaacggagguaagggcucugggggaauuaaaggcgguuuugugcaccaaagaauggcaucgaagaucgggaggugguacucccggacuaugucaaaaauagaacguaagggcaugggacucuauguaaaguacgauggcgaccccugggcugacagugaugcccuugcuuucagcgggguuaugguguccauggaggaaccgggaugguacucuuuugguuucgagauucgcgacaaaaagugcgaugucccuuguaucggcaucgaaauggugcaugacgggggaaaagagaccuggcacagcgccgcaacagccauuuauugccugaugggcucaggucaguugcuaugggauacugugaccggggucaacauggcucuguga

SEQ ID NO: 150791 - RNA, 1401 nt, Artificial Sequence; identical to SEQ ID NO: 150651
  derived and/or modified sequence opt3 from neuraminidase__InfluenzaB__ACI22567

SEQ ID NO: 150792 - RNA, 1401 nt, Artificial Sequence; identical to SEQ ID NO: 150651
  derived and/or modified sequence opt3 from neuraminidase__InfluenzaB__ACI22569

SEQ ID NO: 150793 - RNA, 1401 nt, Artificial Sequence
  derived and/or modified sequence opt3 from neuraminidase__InfluenzaB__ACJ53908
augcugcacagcaccauccagacacucacucuuuuccugacguccggcgggguguuguuaucucuguacgucucagccagucuaagcuaucuccuguacuccgacauucuucugaaguuuucucaaaccgagauaacagcucccaucaugccuuuggauugcgcaaacgccucgucaguucaggcggugaauagaagcgcugccaaaggaguaacucuccugcugccagaaccggaguggaccuaucccaggcucaguuguccugguuccacauuccagaaggcauuacugauuucuccacaucgguuuggcgaaaccaaagggaacagcgcuccccuuaucauucgcgagccuuucaucgccugcggaccaacugaauguaagcacuuugcauugacacauuacgccgcucagcccggcgguuauuacaaugggacccgagaggaccguaacaaacugagacaccuaauauccgugaagcucggaaagaucccuacggucgaaaauucaauuuuccauauggccgcguggaguggcagcgcaugccacgauggcaaagaauggacuuauaucgggguggacggaccagauucuaacgcccugcuuaagauuaaauacggugaggcuuacaccgacacauaucacuccuacgccaagaauauccugaggacucaagaaucagcauguaacugcauaggcggggauuguuauuugaugauuaccgacggaccggcuagcggcaucagugagugccgguuucucaaaauucgcgaggguagaaucaucaaggaaauuuuccccacagggaggguuaagcauaccgaggaauguacgugcggauuugccucuaauaaaacuauagagugugcgugccgggauaacuccuacacagccaagcgcccuuucgugaaacugaaugucgaaaccgacacugcagagauccgauuaaugugcacagagaccuaucuggauacgccaagacccaacgacggcagcauuaccggcccuugugaaucggauggggacaagggaucugguggcaucaaagggggauuugugcaccagaggauggcuuccaagauaggccggugguacucacguacaaugaguaaaacuaagcgcauggguauggggcucuauguaaaguacgacggcgauccauggaccgacagcgaggcccuugcucuguccggaguuauggugucuauggaggagcccggcugguacagcuucggguuugaaauuaaagauaagaaaugcgacgucccguguaucggaaucgagauggugcaugaugguggcaagacaacuuggcacucagccgcaaccgccauuuauugcuugauggggaguggacagcuacugugggacacagugaccggcgucgauauggcucucuga

SEQ ID NO: 150794 - RNA, 1401 nt, Artificial Sequence; identical to SEQ ID NO: 150669
  derived and/or modified sequence opt3 from neuraminidase__InfluenzaB__ACN32560

SEQ ID NO: 150795 - RNA, 1401 nt, Artificial Sequence; identical to SEQ ID NO: 150739
  derived and/or modified sequence opt3 from neuraminidase__InfluenzaB__ACN32582

SEQ ID NO: 150796 - RNA, 1401 nt, Artificial Sequence; identical to SEQ ID NO: 150651
  derived and/or modified sequence opt3 from neuraminidase__InfluenzaB__ACN32593

SEQ ID NO: 150797 - RNA, 1401 nt, Artificial Sequence
  derived and/or modified sequence opt3 from neuraminidase__InfluenzaB__ACN32604
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugaguuuaacggagacaaagguagcggcgggaucaagggaggcuucguacaccagaggauggcaucgaaaauuggucggugguacucucguacuauguccaagaccgagcgcauggggaugggccucuauguuaaauacgacggagaucccugggcugacucagaugcccuugcuuuuaguggcgugauggucagcaugaaggaaccggggugguacuccuucggauucgagaucaaggacaaaaagugcgaugugccuuguauagguauugaaauggugcaugacggcgggaaagagacauggcacucugccgcaacugccaucuauugccugaugggaagcggccaauugcuaugggauaccgucacagguguugacauggcucuguga

SEQ ID NO: 150798 - RNA, 1401 nt, Artificial Sequence; identical to SEQ ID NO: 150651
  derived and/or modified sequence opt3 from neuraminidase__InfluenzaB__ACN32615

SEQ ID NO: 150799 - RNA, 1401 nt, Artificial Sequence
  derived and/or modified sequence opt3 from neuraminidase__InfluenzaB__ACN32775
augcugcccagcaccauccagacacucacucuuuuccugacguccggcgggguguuguuaucucuguacgucucagccagucuaagcuaucuccuguacuccgacauucuucugaaguuuucuccuaccgagauaaacgcuccaacaaugccguuggauugcgcaaaugccucgaacguucacgcggugaauagaucagcuacuaaaggaguaacccuccugcugcccgaaccugaguggacauauccaaggcucagcugucccgguaguaccuuccaaaaggccuuacugaucuccccucaucgguuuggcgaaacuaaagggaacucugcaccacuuauuauccgcgagcccuucauugccugcggaccuaaugaauguaagcacuuugcuuugacacauuacgcagcccagccaggcgguuauuacaacgggacccgaggagaccguaauaaacugagacaccuaaucagcgugaagcucggcaagauaccgacggucgagaacuccaucuuccauauggcugccuggucaggcagugcgugccacgaugggaaagaguggacuuauauuggaguggacggucccgauaauaacgcacugcuuaagaucaaauacggcgaagccuacaccgacacauaucacagcuacgcuaauaacauucugaggacucaggagucugccuguaauugcaucgggggaaacuguuauuugaugauaaccgauggcuccgcaucagguauuagcgaaugccgguuucucaagauccgcgaggggagaauuaucaaagagaucuucccuacaggaaggguuaagcauaccgaagaguguacgugcggcuuugcuaguaauaagucuauugaaugugccugccgggacaacuccuacacugcgaaacgcccauucgugaagcugaacgucgagacagauaccgccgaaauacgauuaaugugcacugacacauaucuggauacccccagaccugacgauggcagcaucacggggccaugugagucgaauggagacaaagguucuggcgggauuaagggaggcuuugugcaccagaggauggcauccaaaaucggucggugguacucacguaccaugaguaagacagagcgcauggggaugggccucuauguaaaauacgacggagaucccugggcugacagcgaugcccuugcuuucuccggcguuauggugucuaugaaggaaccggggugguacagcuuuggauucgagauaaaggacaaaaagugcgaugucccuuguauugguaucgaaauggugcaugacggcgggaaagagacuuggcacucagccgcaaccgccaucuauugccugaugggaaguggccaauugcuaugggauacagugacuggugucgacauggcucuguga

SEQ ID NO: 150800 - RNA, 1401 nt, Artificial Sequence; identical to SEQ ID NO: 150651
  derived and/or modified sequence opt3 from neuraminidase__InfluenzaB__ACN32786

SEQ ID NO: 150801 - RNA, 1401 nt, Artificial Sequence
  derived and/or modified sequence opt3 from neuraminidase__InfluenzaB__ACO05928
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccugggcugauagugacgcccuugcuuucagcggcguuauggugccgauggaggaaccugggugguacuccuuuggauucgaaauaaaagauaagaaaugcgacguccccuguauugguaucgagauggugcacgauggcgggaaggaaacauggcauucugccgcaacugccaucuauugccugaugggaagcggccaguugcuaugggacaccgugacaggugucaacauggcucuguga

SEQ ID NO: 150802 - RNA, 1401 nt, Artificial Sequence; identical to SEQ ID NO: 150663
  derived and/or modified sequence opt3 from neuraminidase__InfluenzaB__ACO05950

SEQ ID NO: 150803 - RNA, 1401 nt, Artificial Sequence
  derived and/or modified sequence opt3 from neuraminidase__InfluenzaB__ACO05961
augcugcccagcaccauccagacacucacucuuuuccugacguccggcgggguguuguuaucucuguacgucucagccagucuaagcuaucucccuuacuccgacauucugcuuaaguuuccaucuaccgagauaacagcuccgacuaugccccuggauugcgcaaacgccucgaauguucaagcggugaacagaucagcuaccaaaggaguaacauugcuccugccugaaccagaguggaccuaucccaggcugagcuguccugguaguacuuuccagaaggcccucuuaaucuccccacaccgguuuggcgaaacaaaaggaaauucugcaccccugauuauccgcgagccuuucauugccugcgggccaaaggaauguaaacauuuugcucuuacccacuacgcagcccagccgggcgguuauuacaacgggacgcgaggagaccguaauaaguugagacaucugaucagcgugaagcuaggcaaaauacccacugucgagaacuccaucuuccacauggcugccuggucaggcagugcgugccaugaugggaaggaguggaccuauauuggaguggacgguccugauaauaacgcacuccugaaaaucaaguacggcgaagccuacacagacacuuaucacagcuacgcuaauaacauucuuaggacccaggagucugccuguaauugcaucgggggaaacuguuaucugaugauaacagauggcuccgcaucagguguuagcgaaugccgguuuuugaaaauucgcgaggggagaaucauuaaggagaucuucccaaccggaaggaucaagcacacggaagaguguacuugcggcuuugcuaguaauaaaacaauugaaugugccugccgggacaacucuuacaccgcgaagcgccccuucgugaaacucaaugucgagacugauacagccgaaauacgacugaugugcaccgagacguauuuagacaccccuagaccagaugacggcuccaucacagggcccugugagagcaacggagauaaggguucgggcgggauuaaaggaggcuuugugcaucaaaggauggcaucuaagaucggucggugguacucccguacuaugucaaaaaccaagcgcauggggaugggccuguauguaaaguacgacggagacccgugggcugauagugacgcccucgcuuucagcggcguuaugguguccauggaggaaccugggugguacucuuuuggauucgaaauaaaagauaagaaaugcgacguccccuguauugguaucgagauggugcacgauggcgggaaggaaacauggcauagcgccgcaacugccaucuauugccuuaugggaucaggccagcuguugugggacaccgugacaggugucaacauggcucuauga

SEQ ID NO: 150804 - RNA, 1401 nt, Artificial Sequence
  derived and/or modified sequence opt3 from neuraminidase__InfluenzaB__ACO05972
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugguguccauggaggaaccgggcugguacucuuucggguuugaaauuaaagauaagaaaugcgacgucccuuguaucggaaucgagauggugcacgaugguggcaagacaacuuggcauagcgccgcaaccgccauuuauugcuugauggggucaggacagcuacugugggacacagugaccggcgucgauauggcucucuga

SEQ ID NO: 150805 - RNA, 1401 nt, Artificial Sequence; identical to SEQ ID NO: 150804
  derived and/or modified sequence opt3 from neuraminidase__InfluenzaB__ACO05983

SEQ ID NO: 150806 - RNA, 1401 nt, Artificial Sequence; identical to SEQ ID NO: 150804
  derived and/or modified sequence opt3 from neuraminidase__InfluenzaB__ACO05994

SEQ ID NO: 150807 - RNA, 1401 nt, Artificial Sequence
  derived and/or modified sequence opt3 from neuraminidase__InfluenzaB__ACO06005
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacagggguucgggcgggaucaagggaggcuuuguacaucaacggauggcaucuaaaauuggucguugguacucccgcacuaugucaaagaccgagagaauggggaugggccucuauguuaaauacgacggagaucccugggcugacagugaugcccuugcuuucagcggcgugauggucuccaugaaggaaccggggugguacucuuuuggauucgagaucaaggacaaaaagugcgaugugccuuguauagguauugaaauggugcacgacggcgggaaagagacauggcauagcgccgcaacugccaucuauugccugaugggaucaggccaguugcuaugggauaccgucacagguguugacauggcucuguga

SEQ ID NO: 150808 - RNA, 1401 nt, Artificial Sequence
  derived and/or modified sequence opt3 from neuraminidase__InfluenzaB__ACO06027
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugguguccauggaggaaccgggcugguacucuuucggguuugaaauuaaagauaagaaaugcgacgucccuuguaucggaaucgagauggugcacgaugguggcaagacaacuuggcauagcgccgcaaccgccauuuauugcuugauggggucaggacagcuacugugggacacagugaccggcgucgauaugacucucuga

SEQ ID NO: 150809 - RNA, 1401 nt, Artificial Sequence
  derived and/or modified sequence opt3 from neuraminidase__InfluenzaB__ACO06066
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucaguagcuaaaggagugacucuccugcugccggaacccgaguggaccuauccuaggcucagcuguccagguaguacauuccagaaggccuuacugauuucuccccaccgguuuggcgaaaccaaaggaaauuccgcaccucuuaucauucgcgagccauucaucgccugcgggcccacugaauguaagcauuuugcuuugacacacuacgcagcccagccuggcgguuauuacaacgggacccgagaggaccguaauaaacugagacaucuaauaagcgucaagcucggaaagaucccaacgguggagaacuccauuuuccacauggcugccuggucaggcagugcgugccaugauggcaaagaauggacuuauaucgggguugacggaccggauagcaaugcacugcuuaagauuaaauacggugaggccuacaccgacacauaucacucuuacgcuaagaacauccugaggacucaagaauccgccuguaauugcauaggcggggauuguuauuugaugauuaccgacggacccgcaucaggcaucagcgagugccgguuucucaaaauucgcgaggguagaaucaucaaggaaauuuucccuacagggagggugaagcacaccgaggaauguacgugcggauuugcuaguaacaaaacuauagagugugccugccgggauaauucuuacacagcgaagcgcccauucgucaaacugaacguggaaaccgacacugccgagauccgauuaaugugcacagagaccuaucuggauacgcccagaccuaaugacggcuccauuaccggcccaugugaaagcgauggggacaagggaucggguggcaucaaagggggauuuguacaucagaggauggcaucuaagauaggccggugguacucccguacaaugucaaaaacuaagcgcauggguauggggcucuauguuaaguacgacggcgaucccuggaccgacagugaggcucuugcccugagcggagugauggucuccauggaggaaccgggcugguacucuuucggguuugaaauuaaagauaagaaaugcgacgugccuuguaucggaaucgagauggugcacgaugguggcaagacaacuuggcauagcgcugccaccgcaauuuauugcuugauggggucaggacagcuacugugggacacagucaccggcguugauaugacucucuga

SEQ ID NO: 150810 - RNA, 1401 nt, Artificial Sequence
  derived and/or modified sequence opt3 from neuraminidase__InfluenzaB__ACO94665
augcugcccagcaccauccagacacucacucuuuuccugacguccggcgggguguuguuaucucuguacgucucagccagucuaagcuaucuccuguacuccgacauucuucugaaguuuucuccuaccgagauaacagcuucgacuaugccauuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuaacaagauucugaggacccaggaguccgccuguaauugcaucgggggaaacuguuauuugaugauaacagauggcucagcaagcgguguuagugaaugccgguuucucaaaauucgcgaggggagaaucauuaaggagaucuuccccaccggaagggugaagcacacggaagaguguacuugcggcuuugcuucuaauaaaacaaucgaaugugccugccgggacaacuccuacaccgcgaagcgcccuuucgucaaacugaauguggagacugauacagccgaaauucgauuaaugugcaccgacacguaucuggauaccccaagacccgacgauggcagcauaacagggccuugugagucgaacggagacaaggguucuggcgggaucaaaggaggcuuuguacaucaaaggauggcauccaagauuggucggugguacucacguacuaugaguaaaaccgagcgcauggggaugggccucuauguuaaguacgacggagauccaugggcugacagcgaugcccuugcuuucuccggcgugauggucucuaugaaggaacccgggugguacagcuuuggauucgagaucaaagacaagaaaugcgaugugccguguauagguauugaaauggugcacgacggcgggaaggagacauggcauucagccgcaacugccaucuauugccugaugggaaguggccaguugcuaugggauaccgucacagguguugacauggcucuguga

SEQ ID NO: 150811 - RNA, 1401 nt, Artificial Sequence; identical to SEQ ID NO: 150651
  derived and/or modified sequence opt3 from neuraminidase__InfluenzaB__ACQ45607

SEQ ID NO: 150812 - RNA, 1401 nt, Artificial Sequence
  derived and/or modified sequence opt3 from neuraminidase__InfluenzaB__ACQ45610
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuguuccguuggauugcgcaaacgccucgaaugugcaagcgguaaacagaucagcuaccaaaggagugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgucaagcucggcaagauaccgacuguggaaaauuccaucuuccacauggcugccuggucaggcagugcgugccaugaugggaaagaguggaccuauauuggaguugacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucaggugugagcgaaugccgguuucucaaaauucgcgaggggagaaucauuaaggagaucuucccuaccggaagggucaaguacacggaagaguguacuugcggcuuugcuaguaauaaaacaaucgaaugugccugccgggacaacucuuauaccgcgaagcgcccauucgugaaacugaauguagagacugauacagccgaaauucgauuaaugugcaccgacacguaccuggauacccccagaccugacgauggcuccauaacagggccaugugagagcaacggagacaaggguucgggcgggaucaaaggaggcuuuguucaccaaaggauggcaucuaagauuggucggugguauucccguacuaugucaaaaaccgagcgcauggggaugggccucuacgugaaguacgacggagaucccugggcugacagugaugcccuugcuuucagcggcgucaugguguccaugaaggaaccggggugguauucuuuuggauucgagaucaaagacaagaaaugcgaugugccuuguauagguauugaaaugguccaugacggcgggaaggagacauggcacagcgccgcaacugccaucuacugccugaugggaucaggccaguugcuaugggauaccguuacagguguggacauggcucuguga

SEQ ID NO: 150813 - RNA, 1401 nt, Artificial Sequence; identical to SEQ ID NO: 150651
  derived and/or modified sequence opt3 from neuraminidase__InfluenzaB__ACQ45613

SEQ ID NO: 150814 - RNA, 1401 nt, Artificial Sequence; identical to SEQ ID NO: 150807
  derived and/or modified sequence opt3 from neuraminidase__InfluenzaB__ACR15626

SEQ ID NO: 150815 - RNA, 1401 nt, Artificial Sequence; identical to SEQ ID NO: 150807
  derived and/or modified sequence opt3 from neuraminidase__InfluenzaB__ACR15637

SEQ ID NO: 150816 - RNA, 1401 nt, Artificial Sequence; identical to SEQ ID NO: 150778
  derived and/or modified sequence opt3 from neuraminidase__InfluenzaB__ACR15648

SEQ ID NO: 150817 - RNA, 1401 nt, Artificial Sequence; identical to SEQ ID NO: 150807
  derived and/or modified sequence opt3 from neuraminidase__InfluenzaB__ACR15659

SEQ ID NO: 150818 - RNA, 1401 nt, Artificial Sequence; identical to SEQ ID NO: 150807
  derived and/or modified sequence opt3 from neuraminidase__InfluenzaB__ACR15670

SEQ ID NO: 150819 - RNA, 1401 nt, Artificial Sequence; identical to SEQ ID NO: 150632
  derived and/or modified sequence opt3 from neuraminidase__InfluenzaB__ACR15681

SEQ ID NO: 150820 - RNA, 1401 nt, Artificial Sequence
  derived and/or modified sequence opt3 from neuraminidase__InfluenzaB__ACR15692
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugggaugcgcaaacgccucgaauguucaagcggugaacagaucagcuaccaaagguguaacacuccugcugcccgaaccugaguggaccuauccaaggcucagcugucccggcaguacuuuccagaaggccuuacugaucuccccucaccgguuuggggaaacaaaaggaaauucugcaccacuuauuauccgcgagcccuucauugccugcggcccuaaggaauguaaacauuuugcuuugacccacuacgcagcccagccagguggguauuacaacggaacgcgaggcgaucguaauaagcugagacaucuaaucagcgugaagcucggcaaaauaccgacugucgagaacuccaucuuccacauggcugccuggucagggagugcgugccaugacggaaaggaguggaccuauauugguguggauggccccgacaauaacgcacugcuuaaaaucaaguacggggaagccuacacagauacuuaucacagcuacgcuaauaacauucugaggacccaggagucugccuguaauugcaucggaggcaacuguuauuugaugauaacagacgguuccgcaucagggauuagcgaaugccgguuucucaaaauccgcgagggaagaauuaucaaggagaucuucccuaccggcaggguuaagcacacggaagaguguacuugcggcuuugcuaguaauaaaacaauugaaugugccugccgggauaacucuuacaccgcgaagcgcccauucgugaaacugaaugucgagacugacacagccgaaauacgauuaaugugcaccgagacguaucuggauacccccagaccugacgauggguccaucacaggaccaugugagagcaacggugacaagggcucugggggaauuaaaggcgguuuugugcaucaaaggauggcaucgaagaucgggcggugguacucccguacuaugucaaaaaccaagcgcaugggcaugggacucuauguaaaguacgauggcgaccccugggcugacaacgaugcccuugcucugagugggguuauggugagcauggaggaaccgggaugguacuccuucgguuuugaaauaaaagacaagaaaugcgaugucccuuguauuggcaucgagauggugcacgacgggggaaaggaaacauggcauucugccgcaacugccaucuauugcuugaugggcagcggucagcuacugugggauaccgugacaggggucgacauggcucucuga

SEQ ID NO: 150821 - RNA, 1401 nt, Artificial Sequence; identical to SEQ ID NO: 150808
  derived and/or modified sequence opt3 from neuraminidase__InfluenzaB__ACR15703

SEQ ID NO: 150822 - RNA, 1401 nt, Artificial Sequence; identical to SEQ ID NO: 150808
  derived and/or modified sequence opt3 from neuraminidase__InfluenzaB__ACR15714

SEQ ID NO: 150823 - RNA, 1401 nt, Artificial Sequence; identical to SEQ ID NO: 150723
  derived and/or modified sequence opt3 from neuraminidase__InfluenzaB__ACR15725

SEQ ID NO: 150824 - RNA, 1401 nt, Artificial Sequence; identical to SEQ ID NO: 150684
  derived and/or modified sequence opt3 from neuraminidase__InfluenzaB__ACR15736

SEQ ID NO: 150825 - RNA, 1401 nt, Artificial Sequence; identical to SEQ ID NO: 150807
  derived and/or modified sequence opt3 from neuraminidase__InfluenzaB__ACR39340

SEQ ID NO: 150826 - RNA, 1401 nt, Artificial Sequence
  derived and/or modified sequence opt3 from neuraminidase__InfluenzaB__ADL28399
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagaucauugaaugugccugccgggacucuuccuacacagcgaaacgcccauucgucaagcugaauguggagaccgauacugccgaaauacgauuaaugugcacagagaccuaucuggacacgcccagaccuaacgauggcagcaucaccgggccaugugagucgaacggagacaaagguucuggcgggauuaagggaggcuuuguacaucaaaggauggcauccaaaaucggucggugguacucacguacaaugaguaagacugaacgcauggggaugggccucuauguuaaauacgauggagaccccugggcugacagcgaugcccuugcucuguccggcgugauggucucuauggaggaaccggggugguacagcuucggauuugagauaaaggacaagaaaugcgaugugccuuguauugguaucgaaauggugcacgacggcgggaaggagaccuggcauucagccgcaacagccaucuauugcuugaugggaaguggccagcuacugugggauacugucaccgguguugacauggcucucuga

SEQ ID NO: 150827 - RNA, 1401 nt, Artificial Sequence; identical to SEQ ID NO: 150804
  derived and/or modified sequence opt3 from neuraminidase__InfluenzaB__ADN32822

SEQ ID NO: 150828 - RNA, 1401 nt, Artificial Sequence
  derived and/or modified sequence opt3 from neuraminidase__InfluenzaB__ADR02756
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucauuccauuggauugcgcaaacgccucgaauguucaggcggugaacagaucagcugccaaaggaguaacucuccugcugccggaacccgaguggaccuauccuaggcucagcuguccagguaguacauuccagaaggcauuacugaucucuccccaccgguuuggcgaaaccaaaggaaauuccgccccucuuauuauccgcgagccauucauagcuugcgggcccacugaauguaagcauuuugcauugacacacuacgccgcucagccuggcgguuauuacaacgggacccgagaggaccguaauaaacugagacaucuaaucagcgugaagcucggaaagauuccaacggucgagaacuccaucuuccacauggccgcguggucaggcagugcaugccaugauggcaaagaauggacuuauauugggguggacggaccggauagcaaugcccugcuuaagaucaaauacggugaggcuuacaccgacacauaucacucuuacgccaagaacauacugaggacucaagaauccgcauguaauugcauuggcggggauuguuauuugaugaucaccgacggacccgcuucaggcauuagcgagugccgguuucucaaaauccgcgaggguagaaucauuaaggaaauauucccuacagggaggguuaagcacaccgaggaauguacgugcggauuugccaguaacaaaacuaucgagugugcgugccgggauaauucuuacacagccaagcgcccauucgugaaacugaacgucgaaaccgacacugcagagauucgauuaaugugcacagagaccuaucuggauacgcccagaccuaaugacggcuccaucaccggcccaugugaaagcgauggggacaagggaucggguggcauaaaagggggauuugugcaucagaggauggcuucuaagauuggccggugguacucccguacaaugucaaaaacuaagcgcauggguauggggcucuauguaaaguacgacggcgaucccuggaccgacagugaggcccuugcucugagcggaguuaugguguccauggaggaaccgggcugguacucuuucggguuugaaaucaaagauaagaaaugcgacgucccuuguaucggaauugagauggugcacgaugguggcaagacaacuuggcauagcgccgcaaccgccaucuauugcuugauggggucaggacagcuacugugggacacagugaccggcgucgauauggcucucuga

SEQ ID NO: 150829 - RNA, 1401 nt, Artificial Sequence
  derived and/or modified sequence opt3 from neuraminidase__InfluenzaB__AEA51353
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacgguggcgccuuuaccgacacauaccacucuuaugcuaagaacauccugucaccccaggaguccgccuguaauugcauagggggagauuguuacuugaugauuacugacggcccugcaagcgguaucagugaaugccgcuuccucaaaauuagagaggggaggaucaucaaggagauuuuuccaaccggacggguuaagcacacagaagaguguaccugcggcuucgcuucuaacaaaacgauagaaugugccugccgcgauaauuccuauacugcgaagcgacccuuugugaaacugaacgucgagacagacaccgccgaaaucagauuaaugugcacugagacauaccuggauaccccuaggccaaaugacggcagcauuacggggcccugugagucgaacggagauaaggguucuggcgggaucaaaggaggcuucgugcaucaacggauggcauccaagauaggucguugguauucacgcaccaugaguaaaacaaagagaauggggaugggccucuacguaaaguaugacggagacccguggacugauagcgaagcucuugcccuguccggcguuauggugucuauggaggaaccugggugguacagcuuuggauucgagauuaaagacaagaaaugcgauguccccuguaucgguaucgaaauggugcacgacggcgggaagaccacauggcauucagcugccacugcaauuuacugcuugaugggaaguggccagcuacugugggauaccgugacaggugucaauaugacccucuga

SEQ ID NO: 150830 - RNA, 1401 nt, Artificial Sequence
  derived and/or modified sequence opt3 from neuraminidase__InfluenzaB__AEA51355
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacaccucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaacgaauguaagcauuuugccuugacgcacuacgcugcacagccaggcgguuauuacaaugggacucgaggagaccguaacaaacugagacaucuaaucagcgugaagcucggcaagauaccgaccgucgaaaauuccaucuuccacauggccgcuuggucaggcagugccugccaugaugggaaagaguggacauauauuggaguggacggucccgauaacaaugcgcugcuuaagaucacuuacggcgaggcauacccugggaccuaucacagcuacgccauuaaaaacccaaggacacaggagucugcucccaauuguuuuggaggccacuccuucccuaucauaacccaugccccacccucagguguuugggaaccgcgguuucugaagauucgcgaggggagaaucauuaacgagaucuucccuacgggaagggugaaacccccagaagagugcacuuguggcuuugcaagcaauaacacaaucgaaugcgcuugucgggacaauaacugcaccgccaagcgcccuuucgucaaguuucacguggagagugaucccgcggaaauucgagccauguguacugacacauauuuggauucuccaagacccgacgauggcuccauaaccgggccuugcgacagcaacggagauaaagguucgggcgggaucaagggaggcuucguacaucaaaggauggagucuaaaauuggucggugguacucccguacgaugucaaagaccgagcgcauggggaugggccucuauguuaaauacgacggagacccaugggcagauagugacgcucuggccaauagcggcgugauggucuccaugaacgaaccggggucuagcucauucggauuugagaucaaggauaaaaagugcgacgugcccuguauagguauugaaauggugcacgauggcgggaaggagacauggcacagugcugccacugcaaucuauugcuuaaugggauccggccagcugcucugggacaccgucacagguguugauauggcccuuuga

SEQ ID NO: 150831 - RNA, 1401 nt, Artificial Sequence
  derived and/or modified sequence opt3 from neuraminidase__InfluenzaB__AEA51357
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauuuggugaggccuacaccgacacauaccacucuuaugcuaagaacauccugggcacucaggaauccgccuguaauugcauagggggagauuguaacuugaugauuaccgacggccccgcaucagguaucagcgagagucgcuuccucaaaauuggggagggaagaaucaucaaggaaauuuuuccuacaggcaggguuaagcacaccgaggaaugcacguguggcuucgcuucuaauaaaacuauagagugcgccugucgggauaacuccuacacagcgaagcgcccauuugugaaacugaaugucgaaaccgacacugccgagauccgauuaaugugcacagagaccuaucuggauacgcccagaccuaacgacgggagcauuaccggaccaugcgaaucgaauggugauaagggcucugggggaaucaaaggcgguuucgugcaucaaaggauggcauccaagauagggcggugguacucacguacaaugaguaaaacugagcgcaugggcaugggacucuauguaaaguacgacggcgaccccugggcugauagcgacgcccuugcuuuuuccgggguuauggugucuaugaaggaaccgggaugguauagcuucgguuucgagauuaaagauaagaaaugugacgucccuugcaucggcaucgaaauggugcacgaugggggaaaggagaccuggcauucagccgcaacagccauuuacugucugaugggcaguggucaguugcuaugggacacugugaccggggucaacauggcucuguga

SEQ ID NO: 150832 - RNA, 1401 nt, Artificial Sequence
  derived and/or modified sequence opt3 from neuraminidase__InfluenzaB__AEA51359
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcgauggggacaagggaucggguggcaucaaagggggauuugugcaucaacguauggcaucuaagauaggccgcugguacuccagaacaaugucaaaaacuaagaggauggguauggggcucuauguaaaguacgacggcgaucccuggaccgacagugaggcucuugcccugagcggaguuaugguguccauggaggaaccgggcugguacucuuucggguuugaaauuaaagauaagaaaugcgacgucccuuguaucggaaucgagauggugcacgaugguggcaagacaacuuggcauagcgcugccaccgcaauuuauugcuugauggggucaggacagcuacugugggacacagugaccggcgucgauauggcccucuga

SEQ ID NO: 150833 - RNA, 1401 nt, Artificial Sequence
  derived and/or modified sequence opt3 from neuraminidase__InfluenzaB__AEA51365
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcaacggggauaagggaucggguggcaucaaagggggauuugugcaucaacguauggcaucuaagauaggccgcugguacuccagaacaaugucaaaaacuaagaggauggguauggggcucuauguaaaguacgacggcgaccccuggaccgauagugaggcucuugcccugagcggaguuaugguguccauggaggaaccgggcugguacucuuucggguuugaaauuaaagacaagaaaugcgaugucccuuguaucggaaucgagauggugcacgacgguggcaagacaacuuggcauagcgcugccaccgcaauuuauugcuugauggggucaggacagcuacugugggauacagugaccggcgucaauaugacucucuga

SEQ ID NO: 150834 - RNA, 1401 nt, Artificial Sequence; identical to SEQ ID NO: 150833
  derived and/or modified sequence opt3 from neuraminidase__InfluenzaB__AEA51367

SEQ ID NO: 150835 - RNA, 1401 nt, Artificial Sequence; identical to SEQ ID NO: 150833
  derived and/or modified sequence opt3 from neuraminidase__InfluenzaB__AEA51371

SEQ ID NO: 150836 - RNA, 1401 nt, Artificial Sequence
  derived and/or modified sequence opt3 from neuraminidase__InfluenzaB__AEA51373
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaagccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguucgggcgggauaaaaggaggcuuuguucaucaaaggauggcaucuaagaucggucggugguacucccguacuaugucaaaaaccaagcgcauggggaugggccucuaugugaaguacgacggagaucccuggacagacagugaggcucuugcccugagcggcgucaugguguccauggaggagccggggugguacucuuucggauuugaaauuaaagauaagaaaugcgacgugccuuguaucgguauagagaugguccacgauggcgggaaggaaacuuggcauagcgcugccaccgcaauuuauugcuugaugggaucaggccagcuacugugggacacaguuaccggugugaacaugacucucuga

SEQ ID NO: 150837 - RNA, 1401 nt, Artificial Sequence
  derived and/or modified sequence opt3 from neuraminidase__InfluenzaB__AEA51377
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccugggcagacagugaugcucuugccuucagcggcgucaugguguccaugaaggagccggggugguacucuuuuggauucgaaauuaaagacaagaaaugcgaugugccuuguaucgguauagagaugguccacgacggcgggaaggaaacauggcauagcgcugccacugcaauuuauugccugaugggaucaggccaguugcuaugggauaccguuacagguguggacauggcccuguga

SEQ ID NO: 150838 - RNA, 1401 nt, Artificial Sequence; identical to SEQ ID NO: 150837
  derived and/or modified sequence opt3 from neuraminidase__InfluenzaB__AEA51379

SEQ ID NO: 150839 - RNA, 1401 nt, Artificial Sequence
  derived and/or modified sequence opt3 from neuraminidase__InfluenzaB__AEA51381
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggaugaagucuaaaaucggucggugguacucccguacuaugucaaagaccgagcgcauggggaugggccucuaugugaaguacgacggagaucccugggcagacagugaugcucuugccuucagcggcgucaugguguccgugaaagaaccggggugguacucuuuuggauucgagauuaaggacaaaaagugcgaugucccuuguaucgguauagaaaugguucacgacggcgggaaagagacauggcauagcgcugccacugcaauuuauugccugaugggaucaggccaguugcuaugggauaccgugacagguguagacauggcccuguga

SEQ ID NO: 150840 - RNA, 1401 nt, Artificial Sequence; identical to SEQ ID NO: 150837
  derived and/or modified sequence opt3 from neuraminidase__InfluenzaB__AEA51383

SEQ ID NO: 150841 - RNA, 1401 nt, Artificial Sequence
  derived and/or modified sequence opt3 from neuraminidase__InfluenzaB__AEG20998
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucuugaggcucgcaugcgccaacgcgucgaauguucaagcugugaaccggucagccacuaaaggaguaacccugcugcucccagaaccggaguggacauauccccgcuuaagcuguccugguaguaccuuccagaaggcacugcuuauuuccccacaccgauuuggcgaaacuaaaggaaauucugcccccuugaucauucgugagccuuucaucgcuugcgggccaaaggaauguaaacauuuugcacugacacacuacgccgcucagcccggcgguuauuacaacgggaccagagaggauaggaauaagcuacggcaucucauaagcgugaagcugggaaaaaucccuacggucgagaacuccauuuuccacauggccgcguggucaggcagugcaugccaugacggccgcgaauggacuuauaucgggguggauggaccagacagcaaugcccuucugaagauuaaauacgguggcgcuuuuaccgauacauaccacucuuaugccaagaacaucuuguccccgcaggagucagcauguaauugcauagggggagacuguuaccucaugauuacugauggccccgcuagcgguaucagugaaugcagauuccugaaaauuagggaggggcggaucaucaaggagauuuuuccuaccggacgcguuaagcacacagaagaguguaccugcggcuucgccucuaacaaaacgauagaaugugcgugccgagacaauuccuauacugccaagagaccauuugugaaauuaaacgucgagacagauaccgcagaaaucaggcugaugugcacugagacauaccucgacacgccccggccuaaugauggcagcauuaccgggccaugugagucgaacggagacaaggguucuggcgggaucaaaggaggcuucgugcaucaacguauggcuuccaagauaggucgcugguauucaagaaccaugaguaaaacaaagaggauggggaugggccuuuacguaaaguaugauggagaccccuggacugacagcgaagcccuggcuuuguccggcguuauggugucuauggaggaaccggggugguacagcuuuggauucgagauuaaagauaagaaaugcgacgucccuuguaucgguaucgaaauggugcacgauggcgggaagaccacauggcauucagccgcaacugccauuuacugccuaaugggaaguggccagcugcucugggacaccgugacaggugucaauaugacccuguga

SEQ ID NO: 150842 - RNA, 1401 nt, Artificial Sequence
  derived and/or modified sequence opt3 from neuraminidase__InfluenzaB__AEG20999
augcugcccagcaccauccagacacucacucuuuuccugacguccggcgggguguuguuaucucugucagucagugccagccuauccuaccuccuguauucugacauucuucugaaguuuucgagaaccgagauaacagcuccuaucaugccauuggauugcgcaaacgccucaaauguucaagcggugaacaggagcgcuacuaaaggaguaacccuccugcugccggaacccgaguggacauacccucggcucaguuguccagguuccaccuuccagaaggccuuacugauuucuccccaccgcuuuggcgaaacuaaagggaauagcgcaccucuuaucauucgagagccauucaucgccugcggacccaaggaauguaaacauuuugcuuugacacacuaugcagcccagccuggcgguuacuauaacgggacccgugaggacagaaauaagcugaggcaucuaauauccgugaagcucggaaaaaucccaacggucgagaacucaauuuuccacauggcugccuggaguggcagcgcgugccaugauggccgggaauggacuuacaucgggguggacggaccggauucuaaugcacugcuuaagauuaaauaugguggcgccuuuaccgacacauaccacuccuacgcuaagaacauccugucaccccaggagagcgccuguaauugcauagggggagauuguuauuugaugauuacugacggcccugcaagugguaucucugaaugccgcuuccucaaaauuagagaggggaggaucaucaaggagauuuuuccaaccggacggguuaagcacacagaagaguguaccugcggcuucgcuuccaacaaaacgauagaaugugccugccgcgauaauagcuacacugcgaagcgacccuuugugaaacugaacgucgagacagacaccgccgaaaucagauuaaugugcacugagacauaucuggauaccccuaggccaaaugacggcucgauuacggggcccugugagucuaacggagauaaggguuccggcgggaucaaaggaggcuucgugcaucaacggauggcaucaaagauaggucguugguacagucgcaccaugagcaaaacaaagagaauggggaugggccucuauguaaaguacgacggagacccguggacugauuccgaagcucuugcccugucuggcguuauggugagcauggaggaaccugggugguauucauuuggauucgagauuaaagacaagaaaugcgauguccccuguaucgguaucgaaauggugcacgacggcgggaagaccacauggcauagugcugccacugcaauuuacugcuugaugggauccggccagcuacugugggauaccgugacaggugucaauaugacccucuga

SEQ ID NO: 150843 - RNA, 1401 nt, Artificial Sequence
  derived and/or modified sequence opt3 from neuraminidase__InfluenzaB__AEG21000
augcugcccagcaccauccagacacucacucuuuuccugacguccggcgggguguuguuaucucuguacgucucagccagucuaagcuaucuccuguacuccgacauucuucugaaguuuucuagaaccgagauaacagcugcaaucuugauucucgauugcgccaacgcgucgaauguucaagcugugaacaggucagccacuaaaggaguaacccugcugcucccugaaccagaguggacauauccgcgguuaagcugucccgguaguaccuuccagaaggcacugcuuaucuccccucaccgcuuuggcgaaacuaaaggaaauucugccccauugauuauccgagagcccuucauagcuugcgggccuaaggaauguaaacauuuugcacugacacacuacgccgcucagccaggcgguuauuacaacgggacccgugaggacagaaauaagcuaaggcaucucaucagcgugaagcugggaaaaauucccacggucgagaacuccaucuuccacauggccgcguggucaggcagugcaugccaugauggccgggaauggacuuauauugggguggacggaccugauagcaaugcccuucugaagaucaaauacgguggcgcuuuuaccgacacauaccacucuuaugccaagaacauauuguccccacaggagucagcauguaauugcauugggggagauuguuaccucaugaucacugacggcccggcuagcgguauuagugaaugccgcuuccugaaaaucagagaggggaggaucauuaaggagauauuucccaccggacggguuaagcacacagaagaguguaccugcggcuucgccucuaacaaaacgaucgaaugugcgugccgcgauaauuccuauacugccaagcgaccuuuugugaaauuaaacgucgagacagacaccgcagaaauuagacugaugugcacugagacauaccucgauaccccaaggcccaaugacggcagcaucacggggccuugugagucgaacggagauaaggguucuggcgggauaaaaggaggcuucgugcaucaacggauggcuuccaagauuggucguugguauucacgcaccaugaguaaaacaaagagaauggggaugggccuuuacguaaaguaugacggagacccauggacugauagcgaagcccuggcuuuguccggcguuauggugucuauggaggaacccgggugguacagcuuuggauucgagaucaaagacaagaaaugcgaugucccguguaucgguauugaaauggugcacgacggcgggaagaccacauggcauucagccgcaacugccaucuacugccuaaugggaaguggccagcugcucugggauaccgugacaggugucaauaugacccuguga

SEQ ID NO: 150844 - RNA, 1401 nt, Artificial Sequence
  derived and/or modified sequence opt3 from neuraminidase__InfluenzaB__AEG21002
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguucgacacaccgaggaauguacgugcggauuugcuaguaacaagacuauagagugugccugcagagauaauucuuacacagcgaaaaggccauucgugaagcugaacgucgaaaccgacacugccgagauccgguuaaugugcacagagaccuaucuggauacgccccguccuaaugacggcuccauuaccggcccaugugaaagcaacggggauaaaggaucggguggcaucaaagggggauuugugcaucaacgcauggcaucuaagauaggcagaugguacuccaggacaaugucaaagacuaaacggauggguauggggcucuauguaaaguacgacggcgaccccuggaccgauagugaggcucuugcccugagcggaguuaugguguccauggaggaaccgggcugguacucuuucggguuugaaauuaaggacaaaaagugcgaugucccuuguaucggaaucgagauggugcacgacgguggcaaaacaacuuggcauagcgcugccaccgcaauuuauugcuugauggggucaggacagcuacugugggauacagugaccggcgucaauaugacucucuga

SEQ ID NO: 150845 - RNA, 1401 nt, Artificial Sequence
  derived and/or modified sequence opt3 from neuraminidase__InfluenzaB__AEG21003
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcgauggggacaagggaucggguggcaucaaagggggauuugugcaucaacguauggcaucuaagauaggccgcugguacuccagaacaaugucaaaaacuaagaggauggguauggggcucuauguaaaguacgacggcgaucccuggaccgacagugaggcucuugcccugagcggaguuaugguguccauggaggaaccgggcugguacucuuucggguuugaaauuaaagauaagaaaugcgacgucccuuguaucggaaucgagauggugcacgaugguggcaagacaacuuggcauagcgcugccaccgcaauuuauugcuugauggggucaggacagcuacugugggacacagugaccggcgucaacaugacucucuga

SEQ ID NO: 150846 - RNA, 1401 nt, Artificial Sequence
  derived and/or modified sequence opt3 from neuraminidase__InfluenzaB__AEG21004
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguggcgggggaauaaaaggcgguuuuguucaucaaaggauggagucgaagaucgggcggugguacucucguacuauguccaaaaccgaacgcaugggcaugggacucuaugugaaguacgacggcgaucccugggcagacucagaugcucuugccuucaguggggucauggugagcaugaaggagccgggaugguacuccuuugguuucgaaauuaaagacaagaaaugcgaugugccuuguaucggcauagagaugguccacgacgggggaaaggaaacauggcauucugcugccacugcaauuuauugccugaugggcagcggucaguugcuaugggauaccguuacagggguggacauggcccuguga

SEQ ID NO: 150847 - RNA, 1401 nt, Artificial Sequence
  derived and/or modified sequence opt3 from neuraminidase__InfluenzaB__AEG21005
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguggcgggggaauaaaaggcgguuuuguucaucaaaggauggagucgaagaucgggcggugguacucucguacuauguccaaaaccgaacgcaugggcaugggacucuaugugaaguacgacggcgaucccugggcagacucagaugcucuugccuucaguggggucauggugagcaugaaggagccgggaugguacuccuuugguuucgaaauuaaagacaagaaaugcgaugugccuuguaucggcauagagaugguccacgacgggggaaaggaaacauggcauucugcugccacugcaauuuauugccugaugggcagcggucaguugcuaugggauaccguuacaggggugaacaugacccuguga

SEQ ID NO: 150848 - RNA, 1401 nt, Artificial Sequence; identical to SEQ ID NO: 150833
  derived and/or modified sequence opt3 from neuraminidase__InfluenzaB__AEG21006

SEQ ID NO: 150849 - RNA, 1401 nt, Artificial Sequence; identical to SEQ ID NO: 150837
  derived and/or modified sequence opt3 from neuraminidase__InfluenzaB__AEG21007

SEQ ID NO: 150850 - RNA, 1401 nt, Artificial Sequence
  derived and/or modified sequence opt3 from neuraminidase__InfluenzaB__AEG21008
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguucgggcgggauaaaaggaggcuuuguucaucaaaggauggcaucuaagaucggucggugguacucccguacuaugucaaaaaccaagcgcauggggaugggccucuaugugaaguacgacggagaucccugggcugacagugaugcccuugcuuucagcggcgucaugguguccaugaaagagccggggugguacucuuuuggauucgaaauuaaggacaaaaagugcgaugugccuuguaucgguauagagaugguccacgacggcgggaaagaaacauggcauagcgccgcaacugccauuuauugccugaugggaucaggccaguugcuaugggauaccguuacagguguggacauggcucuguga

SEQ ID NO: 150851 - RNA, 1401 nt, Artificial Sequence; identical to SEQ ID NO: 150837
  derived and/or modified sequence opt3 from neuraminidase__InfluenzaB__AEG21009

SEQ ID NO: 150852 - RNA, 1401 nt, Artificial Sequence; identical to SEQ ID NO: 150837
  derived and/or modified sequence opt3 from neuraminidase__InfluenzaB__AEG21010

SEQ ID NO: 150853 - RNA, 1401 nt, Artificial Sequence; identical to SEQ ID NO: 150837
  derived and/or modified sequence opt3 from neuraminidase__InfluenzaB__AEG21011

SEQ ID NO: 150854 - RNA, 1401 nt, Artificial Sequence; identical to SEQ ID NO: 150837
  derived and/or modified sequence opt3 from neuraminidase__InfluenzaB__AEG21012

SEQ ID NO: 150855 - RNA, 1401 nt, Artificial Sequence
  derived and/or modified sequence opt3 from neuraminidase__InfluenzaB__AEG21013
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggaugaagucuaaaaucggucggugguacucccguacuaugucaaagaccgagcgcauggggaugggccucuaugugaaguacgacggagaucccugggcagacagugaugcucuugccuucagcggcgucaugguguccaugaaagaaccggggugguacucuuuuggauucgagauuaaggacaaaaagugcgaugugccuuguaucgguauagaaaugguccacgacggcgggaaagagacauggcauagcgcugccacugcaauuuauugccugaugggaucaggccaguugcuaugggauaccguuacagguguggacauggcccuguga

SEQ ID NO: 150856 - RNA, 1401 nt, Artificial Sequence
  derived and/or modified sequence opt3 from neuraminidase__InfluenzaB__AEN68957
augcugcccagcaccauccagacacucacucuuuuccugacguccggcgggguguuguuaucucuguacgucucagccagucuaagcuaucuccuguacuccgacauucuucugaaguuuucuagaaccgagauaccugcuccaaucaugccguuggauugcgcaaacgccucgaauguucaagcggugaacaggucagcuacaaaaggaguaacucuccugcugcccgaaccugaguggaccuauccacggcucagcugucccgguaguacauuccagaaggccuuacugauuuccccucaccgcuuuggcgaaaccaaaggaaauucugcaccacuuaucauucgagagcccuucaucgccugcgggccuaaggaauguaaacauuuugcuuugacucacuacgcagcccagccaggcgguuauuacaacgggacacgugaggacagaaauaagaugaggcaucugauaagcgugaagcuaggaaaaaucccgaccgucgagaacuccauuuuccacauggcugccuggucaggcagugcgugccaugauggccgggaauggacguauaucgggguggacggacccgauagcaaugcacuccugaagauuaaauacggugaggccuacacugacaccuaucacucuuacgcuaagaacauccuucgcacacaggaauccgccuguaauugcauaggcggggauuguuaucugaugauuacugacggaccugcaucaggcaucagcgagugcagauuuuugaaaauuagggagggucggaucaucaaggaaauuuucccaaccgggcgcguuaaguacacagaggaauguaccugcggauuugcuaguaacaaaacgauaggcugugccugccgagauaauucuuauacugcgaagagacccuucgugaaacucaacgucgagacagacaccgccgaaaucaggcugaugugcacugagacauacuuagauaccccucggccaaaugacggcuccauuacggggcccugugagagcaacggagauaaggguucgggcgggaucaaaggaggcuuugugcaccaacguauggcaucuaagauaggucgcugguauuccagaaccaugucaaaaacaaagaggauggggaugggccuguacguaaaguacgacggagacccguggacugauagugaagcucucgcccuuagcggcguuaugguguccauggaggaaccugggugguauucuuucggauuugagauuaaagacaagaaaugcgauguccccuguaucgguaucgaaauggugcaugacggcgggaagaccacauggcacagcgcugccacugcaauuuacugccugaugggaucaggccaguugaugugggauaccgugacaggugucaauaugacccuauga

SEQ ID NO: 150857 - RNA, 1401 nt, Artificial Sequence
  derived and/or modified sequence opt3 from neuraminidase__InfluenzaB__AEO80071
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaccagaggauggcaucuaaaauuggucggugguacucccguacuaugucaaagaccgagcgcauggggaugggccucuauguuaaauacgacggagaucccugggcugacagugaugcccuugcuuucagcggcgugauggucuccaugaaggaaccggggugguacucuuuuggauucgagaucaaggacaaaaagugcgaugugccuuguauagguauugaaauggugcaugacggcgggaaagagacauggcacagcgccgcaacugccaucuauugccugaugggaucaggccaauugcuaugggauaccgucacagguguugacauggcucuguga

SEQ ID NO: 150858 - RNA, 1401 nt, Artificial Sequence
  derived and/or modified sequence opt3 from neuraminidase__InfluenzaB__AEO80082
augcugcccagcaccauccagacacucacucuuuuccugacguccggcgggguguuguuaucucuguacgucucagccagucuaagcuaucuccuguacuccgacauucuucugaaguuuucucaaaccggaauaacagcuccuaucaugccauuggauugcgcaaacgccucgaauguucaggcggugaacagaucagcuacuaaagguguaacccuccugcugccggagcccgaauggacauauccuaggcucagcuguccaggcaguaccuuccagaaggccuuacugauuucuccccaccgguuuggggagacuaaaggaaauuccgcaccucuuaucauucgcgaaccauucaucgccugcggccccacagaguguaaguacuuugcuuugacccauuaugcagcccagccugguggguacuauaacggaacgcgagaagaccguaauaaacugagacaccuaauaagcgugaagcucggcaagaucccaacugucgagaacuccauuuuccauauggcugccuggucaggcagugcgugccacgaugggaaagaguggaccuacaucggaguggacgguccggauagcaaugcacugcuuaagauuaaauacggcgaagccuauacagacacuuaccauucuuaugcuaagaacauccugaggacccaagaguccgccuguaauugcauagggggagauuguuacuugaugauuacagacggccccgcaucagguaucagcgaaugccgguuucucaaaauucgcgaggggagaaucaucaaggagauuuucccuaccggaaggguuaagcacacggaagaguguacuugcggcuuugcuaguaacaaaacaauagaaugugccugccgggauaauucuuauaccgcgaagcgcccauucgugaaacugaacgucgagacugacacagccgaaauccgauuaaugugcaccgagacguaccuggauacccccagaccuaaugacggcuccauuacagggccaugugagagcgauggagacaaggguucgggcgggaucaaaggaggcuuugugcaccagaggauggcaucuaagauaggucggugguauucccguacuaugucaaaaaccaagcgcauggggaugggccucuacguaaaguacgacggagaucccuggacagacagugaagcucuugcccugagcggcguuaugguguccauggaggaaccggggugguauucuuucggauuugagauuaaagauaagaaaugcgacgucccuuguaucgguaucgaaauggugcaugauggcgggaagacuaccuggcacagcgcugccacagcaauuuacugcuugaugggaucaggccagcuacugugggacaccgugacuggugucgauauggcccucuga

SEQ ID NO: 150859 - RNA, 1401 nt, Artificial Sequence; identical to SEQ ID NO: 150698
  derived and/or modified sequence opt3 from neuraminidase__InfluenzaB__AEO80090

SEQ ID NO: 150860 - RNA, 1401 nt, Artificial Sequence; identical to SEQ ID NO: 150643
  derived and/or modified sequence opt3 from neuraminidase__InfluenzaB__AEO80101

SEQ ID NO: 150861 - RNA, 1401 nt, Artificial Sequence; identical to SEQ ID NO: 150739
  derived and/or modified sequence opt3 from neuraminidase__InfluenzaB__AEO80149

SEQ ID NO: 150862 - RNA, 1401 nt, Artificial Sequence; identical to SEQ ID NO: 150651
  derived and/or modified sequence opt3 from neuraminidase__InfluenzaB__AEO80158

SEQ ID NO: 150863 - RNA, 1401 nt, Artificial Sequence; identical to SEQ ID NO: 150651
  derived and/or modified sequence opt3 from neuraminidase__InfluenzaB__AEO80167

SEQ ID NO: 150864 - RNA, 1401 nt, Artificial Sequence; identical to SEQ ID NO: 150739
  derived and/or modified sequence opt3 from neuraminidase__InfluenzaB__AEO80176

SEQ ID NO: 150865 - RNA, 1401 nt, Artificial Sequence
  derived and/or modified sequence opt3 from neuraminidase__InfluenzaB__AEO80187
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugggaugcgcaaacgccucgaauguucaagcggugaacagaucagcuaccaaagguguaacacuccugcugcccgaaccugaguggaccuauccaaggcucagcugucccggcaguacuuuccagaaggccuuacugaucuccccucaccgguuuggggaaacaaaaggaaauucugcaccacuuauuauccgcgagcccuucauugccugcggcccuaacgaauguaagcauuuugcuuugacccacuacgcagcccagccagguggguauuacaauggaacgcgaggcgaucguaacaaacugagacaucuaaucagcgugaagcucggcaagauaccgacugucgaaaauuccaucuuccacauggcugccuggucagggagugcgugccaugacggaaaagaguggaccuauauugguguggauggccccgacaacaaugcacugcuuaagaucaaauacggggaggccuacacagauacuuaucacagcuacgcuaacaagauucugaggacccaggagucugccuguaauugcaucggaggcaacuguuauuugaugauaacagacgguuccgcaucagggguuagcgaaugccgguuucucaaaauucgcgagggaagaaucauuaaggagaucuucccuaccggcagggugaagcacacggaagaguguacuugcggcuuugcuaguaauaaaacaaucgaaugugccugccgggauaacucuuacaccgcgaagcgcccauucgucaaacugaauguggagacugacacagccgaaauucgauuaaugugcaccgauacguaucuggacacccccagaccugaugacggguccauaacaggaccaugugagagcaacggugauaggggcucugggggaaucaagggcgguuuuguacaucaacggauggcaucgaaaauugggcguugguacucccgcacuaugucaaagaccgagagaaugggcaugggacucuauguuaaauacgacggcgaccccugggcugauagugacgcccuugcuuucagcggggugauggucuccaugaaggaaccgggaugguacucuuuugguuucgagaucaaggauaaaaagugcgacgugccuuguauaggcauugaaauggugcacgaugggggaaaagagacauggcauagcgccgcaacugccaucuauugccugaugggcucaggucaguugcuaugggacaccgucacagggguugauauggcucuguga

SEQ ID NO: 150866 - RNA, 1401 nt, Artificial Sequence
  derived and/or modified sequence opt3 from neuraminidase__InfluenzaB__AEO80198
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacagggguucgggcgggaucaagggaggcuuuguacaucaacggauggcaucuaaaauuggucguugguacucccgcacuaugucaaagaccgagagaauggggaugggccucuauguuaaauacgacggagaucccugggcugacagugaugcccuugcuuucaggggcgugauggucagcaugaaggaaccggggugguacuccuuuggauucgagaucaaggacaaaaagugcgaugugccuuguauagguauugaaauggugcacgacggcgggaaagagacauggcauucugccgcaacugccaucuauugccugaugggaagcggccaguugcuaugggauaccgucacagguguugacauggcucuguga

SEQ ID NO: 150867 - RNA, 1401 nt, Artificial Sequence; identical to SEQ ID NO: 150807
  derived and/or modified sequence opt3 from neuraminidase__InfluenzaB__AEO80209

SEQ ID NO: 150868 - RNA, 1401 nt, Artificial Sequence
  derived and/or modified sequence opt3 from neuraminidase__InfluenzaB__AEO80220
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggacucacacugcugcuccccgaaccugaguggaccuauccaagguuaagcugucccgguaguacuuuccagaaggcccugcuuaucuccccucaccgguuuggcgaaacaaaaggaaauucugcaccauugauuauccgcgagcccuucauugccugcgggccuaacgaauguaagcauuuugcucugacccacuacgcagcccagccaggcgguuauuacaaugggacgcgaggagaccguaacaaacuaagacaucucaucagcguaaagcugggcaagauaccgacuguggagaccuccaucuuccacauggcugccuggucaggcagugcgugccaugaugggaaagaguggacauauauuggagucgacggucccgauaauaacgcacuucugaagaucaaauacggcgaagccuacacugacaccuaucacagcuacgcuaauaagauuuugaggacacaggagucugccuguaacugcaucgggggaaauuguuaucucaugauaaccgauggcuccgcaucaggugugagcgaaugccgguuucugaaaauucgcgaggggagaaucauuaaggagaucuucccuacgggaaggguuaagcacacugaagaguguacaugcggcuuugcuaguaacaaaaccaucgaaugugccugccgggacaauucuuacacugcgaagcgcccauucgugaaauuaaacgucgagacagauaccgccgaaauucgacugaugugcacggacaccuaucucgauacacccagaccugacgauggcuccauaacugggccaugugagagcaauggagacagggguucgggcgggaucaagggaggcuuugugcaucaacggauggcaucuaaaauuggucguugguacucccgcaccaugucaaagacagagagaauggggaugggccuuuauguaaaauacgacggagaucccugggcugacagugaugcccuggcuuucagcggcguuaugguguccaugaaggaaccggggugguacucuuuuggauucgagaucaaggacaaaaagugcgaugucccuuguauagguauugaaauggugcacgacggcgggaaagagacuuggcauagcgccgcaaccgccaucuauugcuugaugggaucaggccagcuacugugggauacagugaccggugucgacauggcucucuga

SEQ ID NO: 150869 - RNA, 1401 nt, Artificial Sequence; identical to SEQ ID NO: 150804
  derived and/or modified sequence opt3 from neuraminidase__InfluenzaB__AEO80231

SEQ ID NO: 150870 - RNA, 1401 nt, Artificial Sequence; identical to SEQ ID NO: 150807
  derived and/or modified sequence opt3 from neuraminidase__InfluenzaB__AEO80242

SEQ ID NO: 150871 - RNA, 1401 nt, Artificial Sequence; identical to SEQ ID NO: 150651
  derived and/or modified sequence opt3 from neuraminidase__InfluenzaB__AEP20182

SEQ ID NO: 150872 - RNA, 1401 nt, Artificial Sequence
  derived and/or modified sequence opt3 from neuraminidase__InfluenzaB__AEP20193
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaccagaggauggcaucuaaaauuggucggugguacucccguacuaugucaaagaccgagcgcauggggaugggccucuauguuaaauacgacggagaucccugggcugacagugaugcccuugcuuucagcggcgugauggucuccgugaaggaaccggggugguacucuuuuggauucgagaucaaggacaaaaagugcgaugugccuuguauagguauugaaaugguccaugacggcgggaaagagacauggcacagcgccgcaacugccaucuauugccugaugggaucaggccaauugcuaugggauaccguuacagguguggacauggcucuguga

SEQ ID NO: 150873 - RNA, 1401 nt, Artificial Sequence
  derived and/or modified sequence opt3 from neuraminidase__InfluenzaB__AEP20204
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacaaggguucgggcgggaucaaaggaggcuuuguacaucaaaggauggcaucuaagauuggucggugguacucccguacuaugucaaaaaccgagcgcauggggaugggccucuauguuaaguacgacggagaucccugggcugacagugaugcccuugcuuucagcggcgugauggucuccaucaaggaaccggggugguacucuuuuggauucgagauaaaagacaagaaaugcgaugugccuuguauugguaucgaaauggugcacgacggcgggaaggagacauggcauagcgccgcaacugccaucuauugccugaugggaucaggccaguugcuaugggauaccgucacagguguugacauggcucuguga

SEQ ID NO: 150874 - RNA, 1401 nt, Artificial Sequence; identical to SEQ ID NO: 150703
  derived and/or modified sequence opt3 from neuraminidase__InfluenzaB__AEP20215

SEQ ID NO: 150875 - RNA, 1401 nt, Artificial Sequence
  derived and/or modified sequence opt3 from neuraminidase__InfluenzaB__AEP20237
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugaugccgcagaaauacgauuaaugugcacagagaccuaucuggacacgcccagaccugaugacggcagcaucaccgggccaugugagucgaauggagauaaggguucuggcgggauuaaaggaggcuuugugcaucaaaggauggcuuccaagaucggucggugguacucacguacaaugaguaaaacuaagcgcauggggaugggccucuauguaaaguacgacggagaccccuggaccgauagcgacgcccuugcucuguccggcguuauggugucuauggaggaaccggggugguacagcuucggauuugaaauaaaagauaagaaaugcgacgucccuuguauugguaucgagauggugcacgauggcgggaaggaaacauggcauucagccgcaacugccaucuauugcuugaugggaaguggccagcuacugugggacaccgugacaggugucgauauggcucucuga

SEQ ID NO: 150876 - RNA, 1401 nt, Artificial Sequence; identical to SEQ ID NO: 150703
  derived and/or modified sequence opt3 from neuraminidase__InfluenzaB__AEP20248

SEQ ID NO: 150877 - RNA, 1401 nt, Artificial Sequence
  derived and/or modified sequence opt3 from neuraminidase__InfluenzaB__AEP20259
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagaucauugaaugugccugccgggacaauucuuacacagcgaaacgcccauucgucaagcugaacguggagaccgauacugccgaaauacgauuaaugugcacagagaccuaucuggacacgcccagaccugaugacggcuccaucaccgggccaugugagagcaacggagauaaagguucgggcgggauuaagggaggcuuuguacaucaaaggauggcaucuaaaaucggucggugguacucccguacaaugucaaagacugaacgcauggggaugggccucuauguuaaauacgacggagaccccugggcugauagugacgcccuugcucugagcggcgugauggucuccauggaggaaccggggugguacucuuucggauuugagauaaaggauaagaaaugcgacgugccuuguauugguaucgaaauggugcacgauggcgggaaggagaccuggcauagcgccgcaacagccaucuauugcuugaugggaucaggccagcuacugugggacacugucaccgguguugauauggcucucuga

SEQ ID NO: 150878 - RNA, 1401 nt, Artificial Sequence
  derived and/or modified sequence opt3 from neuraminidase__InfluenzaB__AEP20281
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucaaccacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaacgaauguaagcauuuugccuugacgcacuacgcugcacagccaggcgguuauuacaaugggacucgaggagaccguaacaaacugagacaucuaaucagcgugaagcucggcaagauaccgaccgucgaaaauuccaucuuccacauggccgcuuggucaggcagugccugccaugaugggaaagaguggacauauauuggaguggacggucccgauaacaaugcgcugcuuaagaucaaauacggcgaggcauacacugacaccuaucacagcuacgccaacaauauucugaggacacaggagucugcuuguaacugcaucgggggaaauuguuauuugaugauaaccgauggcuccgccucagguguuagcgaaugccgguuucucaagauucgcgaggggagaaucauuaaagagaucuucccuacgggaagggugaagcacacugaagaguguacaugcggcuuugcaaguaacaagaccaucgaaugugcuugccgggacaauucuuacacugccaaacgcccauucgucaagcugaacguggagacagauaccgcggaaauucgauuaaugugcacggagaccuaucuggacacacccagaccugaugacggcuccauaacugggccaugugagagcaacggagauaaagguucgggcgggaucaagggaggcuuuguacaucaaaggauggccucuaaaauuggucggugguacucccguaccaugucaaagacagaacgcauggggaugggccucuauguuaaauacgacggagaccccugggcagauagugacgcucuugcccugagcggcgugauggucuccauggaggaaccggggugguacucuuucggauuugagaucaaggauaagaaaugcgacgugccuuguauagguauugaaauggugcacgauggcgggaaggagacuuggcauagcgcugccaccgcaaucuauugcuugaugggaucaggccagcuacugugggacacagucaccgguguugauauggcccucuga

SEQ ID NO: 150879 - RNA, 1401 nt, Artificial Sequence; identical to SEQ ID NO: 150651
  derived and/or modified sequence opt3 from neuraminidase__InfluenzaB__AEP20292

SEQ ID NO: 150880 - RNA, 1401 nt, Artificial Sequence; identical to SEQ ID NO: 150643
  derived and/or modified sequence opt3 from neuraminidase__InfluenzaB__AEP20303

SEQ ID NO: 150881 - RNA, 1401 nt, Artificial Sequence
  derived and/or modified sequence opt3 from neuraminidase__InfluenzaB__AEP20314
augcugcccagcaccauccagacacucacucuuuuccugacguccggcgggguguuguuaucucuguacgucucagccagucuaagcuaucuccuguacuccgacauucuucugaaguuuucucaaaccggaauaacagcuccuaucaugccauuggauugcgcaaacgccucgaauguucaggcggugaacagaucagcuacuaaagguguaacccuccugcugccggagcccgaauggacauauccuaggcucagcuguccaggcaguaccuuccagaaggccuuacugauuucuccccaccgguuuggggagacuaaaggaaauuccgcaccucuuaucauucgcgaaccauucaucgccugcggccccaaggaguguaaacauuuugcuuugacacacuacgcagcccagccugguggguauuacaacggaacccgagaagaccguaauaagcugagacaucuaauaagcgugaagcucggcaaaaucccaacggucgagaacuccauuuuccacauggcugccuggucaggcagugcgugccaugaugggagggaguggacuuauaucggaguggacgguccggauagcaaugcacugcuuaagauuaaauacggcgaagccuacaccgacacauaucacucuuacgcuaagaacauccugcggacucaagaguccgccuguaauugcauagggggagauuguuauuugaugauuaccgacggccccgcaucagguaucagcgaaugccgcuuucucaaaauuagagaggggaggaucaucaaggagauuuucccuacaggacggguuaagcacaccgaagaguguacgugcggcuuugcuaguaacaaaacuauagaaugugccugccgcgauaauucuuacacagcgaagcgaccauucgugaaacugaacgucgagaccgacacugccgaaaucagauuaaugugcacagagaccuaucuggauacgcccaggccuaaugacggcuccauuaccgggccaugugagagcaacggagauaaggguucgggcgggaucaaaggaggcuuugugcaucagcggauggcaucuaagauaggucguugguacucccgcacaaugucaaaaacuaagagaauggggaugggccucuauguaaaguacgacggagaccccuggaccgauagugaagcucuugcccugagcggcguuaugauuuccauggaggaaccggggugguacucuuucggauuugagaucaaagacaagaaaugcgaugugccuuguaucgguauugaaaugguccacgacggcgggaagacaacuuggcauagcgcugccaccgcaaucuauugcuugaugggaucaggccagcuacugugggauacagugaccgguguggacauggcccucuga

SEQ ID NO: 150882 - RNA, 1401 nt, Artificial Sequence
  derived and/or modified sequence opt3 from neuraminidase__InfluenzaB__AEP20336
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgagacguaucuggacacccccagaccugaugacggcuccauaacagggccaugugagagcaacggagauaaagguucgggcgggaucaagggaggcuuuguacaucaaaggauggcaucuaaaauuggucggugguacucccguacuaugucaaagaccgaacgcauggggaugggccucuauguuaaauacgacggagaccccugggcugauagugacgcccuuacacugagcggcgugauggucuccauggaggaaccggggugguacucuuucggauuugagaucaaggauaagaaaugcgacgugccuuguauagguauugaaauggugcacgauggcgggaaggagacuuggcauagcgcugccaccucaaucuauugcuugaugggaaguggccagcuacugugggacacagucaccgguguugauauggcacucuga

SEQ ID NO: 150883 - RNA, 1401 nt, Artificial Sequence
  derived and/or modified sequence opt3 from neuraminidase__InfluenzaB__AEP20347
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcucuauguaaaguacgacggcgaucccuggacagacagugaggcucuugcccugagcggaguuauggugccgauggaggaaccuggcugguacuccuucggguuugaaauuaaagauaagaaaugcgacguccccuguaucggaaucgagauggugcacgaugguggcaagacuaccuggcauucugcugccacagcaauuuauugcuugauggggagcggacagcuacugugggacaccgugacuggcgucgauauggcccucuga

SEQ ID NO: 150884 - RNA, 1401 nt, Artificial Sequence; identical to SEQ ID NO: 150883
  derived and/or modified sequence opt3 from neuraminidase__InfluenzaB__AEP20358

SEQ ID NO: 150885 - RNA, 1401 nt, Artificial Sequence; identical to SEQ ID NO: 150883
  derived and/or modified sequence opt3 from neuraminidase__InfluenzaB__AEP20369

SEQ ID NO: 150886 - RNA, 1401 nt, Artificial Sequence; identical to SEQ ID NO: 150883
  derived and/or modified sequence opt3 from neuraminidase__InfluenzaB__AEP20380

SEQ ID NO: 150887 - RNA, 1401 nt, Artificial Sequence
  derived and/or modified sequence opt3 from neuraminidase__InfluenzaB__AEP20391
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacagacugaggcaucuaaucagcgugaaacucggcaagauaccgacugucgaaaauuccaucuuccacauggcugccuggucaggcagugcgugccaugaugggaaggaguggaccuauauuggaguggacggucccgauaacaaugcacugcuuaaaaucaaguacggcgaggccuacacagacacuuaucacagcuacgcuaacaauauucugcggacccaggagucugccuguaacugcaucgggggaaauuguuauuugaugauaacagauggcuccgcaucagguguuagcgaaugccgcuuucucaaaauuagagaggggaggaucauuaaggagaucuucccuaccggacgggugaaacacacggaagaguguacuugcggcuuugcuaguaacaagacaaucgaaugugccugccgcgacaauucuuacaccgcgaagcgaccauucgucaaacugaacguggagacugauacagccgaaauuagauuaaugugcaccgacacguaucuggauacccccaggccugacgauggcuccauaacagggccaugugagagcaacggagacaaggguucgggcgggaucaaaggaggcuuuguacaucaacggauggcaucuaagguuggucguugguacucccgcacuaugucaaaaaccgagagaauggggaugggccucuaugugaaguacgacggagaucccugggcugacagugaugcccuugcuuucagcggcgucaugguguccaugaaagaaccggggugguacucuuuuggauucgagauuaaggacaagaaaugcgaugugccuuguaucgguauagaaaugguccacgacggcgggaaggagacauggcauagcgccgcaacugccauuuauugccugaugggaucaggccaguugcuaugggauaccguuacagguguggacauggcucuguga

SEQ ID NO: 150888 - RNA, 1401 nt, Artificial Sequence
  derived and/or modified sequence opt3 from neuraminidase__InfluenzaB__AEP20413
augcugcccagcaccauccagacacucacucuuuuccugacguccggcgggguguuguuaucucuguacgucucagcccuacucaguuaucugcuuuacagcgacauucuguugaaguuuuccccuaccgagauaaucgcuccaacaaugucucucgauugcgcaaacgccucgaauguucaagcggugaacagaucagcuacuaaaggaguaaccuuccugcugccggaacccgaguggacauauccuaggcucagcuguccagguaguaccuuucagaaggccuuacugauuucuccccaccgguucggcgaaacuaaaggaaauuccgcaccucuuaucauucgcgagccauuuaucgccugcgggcccaacgaauguaagcauuucgcuuugacacacuacgcagcccagccuggcgguuauuacaaugggacccgaggagaccguaacaaacugagacaucuaauaagcgugaagcucggcaagaucccaacggucgaaaauuccauuuuucacauggcugccuggucaggcagugcgugccaugaugggaaagaguggacuuauaucggaguggacgguccggauaacgacgcacugcuuaagguuaaauacggcgaggccuacaccgauacauaucacagcuacgcuaauaagauucugaggacucaggagucugccuguaacugcaucgggggaaauuguuauuugaugauaaccgacggcuccgcaucaggugugagcgaaugccgguuccucaaaauucgcgaggggagaaucauuaaggagaucuuucccacaggaagggucaagcacaccgaagaguguacgugcggcuucgcuaguaacaaaacuaucgaaugugccugccgggauaauucuuacacagcgaagcgcccuuuugugaaacugaacguagagaccgacacugccgaaauucgauuaaugugcacagauaccuaucuggacacgccaagacccgaugacggcuccauaaccgggccuugugagagcaauggagacaaggguucgggcgggaucaaaggaggcuucguucaucaaaggauggagucuaagauuggucggugguacucccguacaaugucaaaaacugaacgcauggggaugggccucuaugugaaguacaacggagauccaugggcagacagugaugcucuugccuuuagcggcgucaugguguccaugaaggagcccgggugguacucuuucggauucgaaaucaaagacaagaaaugcgaugugccguguauagguauugagaugguccacgacggcgggaaggaaaccuggcauagcgcugccacagcaaucuauugccugaugggaucaggccaguugcuaugggauacuguuaccgguguggacauggcccuguga

SEQ ID NO: 150889 - RNA, 1401 nt, Artificial Sequence; identical to SEQ ID NO: 150888
  derived and/or modified sequence opt3 from neuraminidase__InfluenzaB__AEP20435

SEQ ID NO: 150890 - RNA, 1401 nt, Artificial Sequence; identical to SEQ ID NO: 150883
  derived and/or modified sequence opt3 from neuraminidase__InfluenzaB__AEQ39031

SEQ ID NO: 150891 - RNA, 1401 nt, Artificial Sequence
  derived and/or modified sequence opt3 from neuraminidase__InfluenzaB__AEQ39275
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaaccugaguggacauauccaagacucagcugucccgguaguaccuuccagaaagccuuacugaucuccccucauagguuuggcgaaacuaagggaaauucugcaccacuuauuauccgggagcccuucauugccugcgggccuaacgaauguaaacacuuugcuuugacacauuacgcagcccagccaggcgguuauuacaaugggacccgcggagaccgaaacaagcugcgucaccuaaucagcgugaagcucggcaaaauaccgacggucgaaaauuccaucuuccauauggcugccuggucaggcagugcgugccacgaugggaaggaguggacuuauauuggaguggacggucccgauaacaaugcacugcuuaaaguuaaguacggcgaggccuacaccgacacauaucacagcuacgcuaacaaaauccugagaacucaggagucugccuguaauugcauugggggaaacuguuauuugaugaucaccgauggcuccgcaucaggugugagcgaaugcagguuucucaagauacgggaggggcgcauuaucaaggagauuuucccuacaggaagagucaaacauaccgaagaguguacgugcggcuuugcuaguaauaagacuaucgaaugugccugcagggacaacucuuacacagcgaaacggccauucgugaagcugaauguagagaccgauacugccgaaauccgcuuaaugugcacagacaccuaucuggauacgccccgaccugacgauggcuccauuaccgggccaugugagagcaacggagacaaagguucgggcgggauaaagggaggcuuuguucaccaaagaauggagucuaaaaucgguaggugguacucccggacaaugucaaagacugaacguauggggaugggccucuaugugaaguacgacggagaucccugggcagacagugaugcucuugccuucagcggcgucaugguguccaugaaagagccggggugguacucuuuuggauucgaaauuaaggacaaaaagugcgaugugccuuguaucgguauagagaugguccaugacggcgggaaagaaaccuggcacagcgcugccacagcaauuuauugccugaugggaucaggccaguugcuaugggauacuguuaccgguguggacauggcccuguga

SEQ ID NO: 150892 - RNA, 1401 nt, Artificial Sequence; identical to SEQ ID NO: 150891
  derived and/or modified sequence opt3 from neuraminidase__InfluenzaB__AEQ39286

SEQ ID NO: 150893 - RNA, 1401 nt, Artificial Sequence; identical to SEQ ID NO: 150891
  derived and/or modified sequence opt3 from neuraminidase__InfluenzaB__AEQ39297

SEQ ID NO: 150894 - RNA, 1401 nt, Artificial Sequence; identical to SEQ ID NO: 150891
  derived and/or modified sequence opt3 from neuraminidase__InfluenzaB__AEQ39308

SEQ ID NO: 150895 - RNA, 1401 nt, Artificial Sequence; identical to SEQ ID NO: 150891
  derived and/or modified sequence opt3 from neuraminidase__InfluenzaB__AEQ39319

SEQ ID NO: 150896 - RNA, 1401 nt, Artificial Sequence
  derived and/or modified sequence opt3 from neuraminidase__InfluenzaB__AEQ39330
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaaccugaguggacauauccaagacucagcugucccgguaguaccuuccagaaagccuuacugaucuccccucauagguuuggcgaaacuaagggaaauucugcaccacuuauuauccgggagcccuucauugccugcgggccuaacgaauguaaacacuuugcuuugacacauuacgcagcccagccaggcgguuauuacaaugggacccgcggagaccgaaacaagcugcgucaccuaaucagcgugaagcucggcaaaauaccgacggucgaaaauuccaucuuccauauggcugccuggucaggcagugcgugccacgaugggaaggaguggacuuauauuggaguggacggucccgauaacaaugcacugcuuaaaguuaaguacggcgaggccuacaccgacacauaucacagcuacgcuaacaaaauccugagaacucaggagucugccuguaauugcauugggggaaacuguuauuugaugaucaccgauggcuccgcaucaggugugagcgaaugcagguuucucaagauacgggaggggcgcauuaucaaggagauuuucccuacaggaagagucaaacauaccgaagaguguacgugcggcuuugcuaguaauaagacuaucgaaugugccugcagggacaacucuuacacagcgaaacggccauucgugaagcugaauguagagaccgauacugccgaaauccgcuuaaugugcacagacaccuaucuggauacgccccgaccugacgauggcuccauuaccgggccaugugagagcaacggagacaaagguucgggcgggauaaagggaggcuuuguucaccaaagaauggagucuaaaaucgguaggugguacucccggacaaugucaaagacugaacguauggggaugggccucuaugugaaguacgacggagaucccugggcagacagugaugcucuugccuucagcggcgucaugguguccaugaaagagccggggugguacucuuuuggauucgaaauuaaggacaaaaagugcgaugugccuuguaucgguauagagaugguccaugacggcgggaaagaaaccuggcacagcgcugccacagcaauuuauugccugaugggaucaggccaguugcuaugggauacuguuaccgguguggacaucgcccuguga

SEQ ID NO: 150897 - RNA, 1401 nt, Artificial Sequence; identical to SEQ ID NO: 150891
  derived and/or modified sequence opt3 from neuraminidase__InfluenzaB__AEQ39341

SEQ ID NO: 150898 - RNA, 1401 nt, Artificial Sequence; identical to SEQ ID NO: 150891
  derived and/or modified sequence opt3 from neuraminidase__InfluenzaB__AEQ39352

SEQ ID NO: 150899 - RNA, 1401 nt, Artificial Sequence; identical to SEQ ID NO: 150891
  derived and/or modified sequence opt3 from neuraminidase__InfluenzaB__AEQ39363

SEQ ID NO: 150900 - RNA, 1401 nt, Artificial Sequence; identical to SEQ ID NO: 150857
  derived and/or modified sequence opt3 from neuraminidase__InfluenzaB__AEQ39374

SEQ ID NO: 150901 - RNA, 1401 nt, Artificial Sequence
  derived and/or modified sequence opt3 from neuraminidase__InfluenzaB__AEQ39385
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggccaugugagucgaauggagauaaggguucuggcgggauuaaaggaggcuuugugcaucaaaggaugacuuccaagaucggucggugguacucacguaccaugaguaaaacaaagcgcauggggaugggccucuauguaaaguacgacggagaccccuggacugauagcgacgcacuugcucuguccggcguuauggugucuauggaggaaccggggugguacagcuucggauuugaaauaaaagauaagaaaugcgacgucccuuguauugguaucgagauggugcacgauggcgggaaggaaaccuggcauucagccgcuacagccaucuauugcuugaugggaaguggccagcuacugugggacaccgugacuggugucgauauggcacucuga

SEQ ID NO: 150902 - RNA, 1401 nt, Artificial Sequence
  derived and/or modified sequence opt3 from neuraminidase__InfluenzaB__AEQ39444
augcugcccagcaccauccagacacucacucuuuuccugacguccggcgggguguuguuaucucuguacgucucagccagucuaagcuaucuccuguacuccgacauucuucugaaguuuucucaaaccgagauaaucgcuccuauuaugccauuggauugcgcaaacgccucgaauguucaggcggugaacagaucagcuacaaaaggaguaacucuccugcugccggaacccgaguggaccuauccuaggcucagcuguccagguaguacauuccagaaggccuuacugaucucuccccaccgguuuggcgaaaccaaaggaaauuccgcaccucuuauuauccgcgagccauucauagccugcgggcccacugaauguaagcauuuugcuuugacacacuacgcagcccagccuggcgguuauuacaacgggacccgagaggaccguaauaaacugagacaucuaaucagcgugaagcucggaaagauuccaacggucgagaacuccaucuuccacauggcugccuggucaggcagugcgugccaugauggcaaagaauggacuuauauugggguggacggaccggauagcaaugcacugcuuaagaucaaauacggugaggccuacaccgacacauaucacucuuacgcuaagaacauacugaggacucaagaauccgccuguaauugcauuggcggggauuguuauuugaugaucaccgacggacccgcaucaggcauuagcgagugccgguuucucaaaauccgcgaggguagaaucauuaaggaaauauucccuacagggaggguuaagcacaccgaggaauguacgugcggauuugcuaguaacaaaacuaucgagugugccugccgggauaauucuuacacagcgaagcgcccauucgugaaacugaacgucgaaaccgacacugccgagauucgauuaaugugcacagagaccuaucuggauacgcccagaccuaaugacggcuccaucaccggcccaugugaaagcgauggggacaagggaucggguggcauaaaagggggauuugugcaucagaggauggcaucuaagauuggccggugguacucccguacaaugucaaaaacuaagcgcauggguauggggcucuauguaaaguacgacggcgaucccuggaccgacagugaggcucuugcccugagcggaguuaugguguccauggaggaaccgggcugguacucuuucggguuugaaaucaaagauaagaaaugcgacgucccuuguaucggaauugagauggugcacgaugguggcaagacaacuuggcauagcgcugccaccgcaaucuauugcuugauggggucaggacagcuacugugggacacagugaccggcgucgauauggcccucuga

SEQ ID NO: 150903 - RNA, 1401 nt, Artificial Sequence; identical to SEQ ID NO: 150804
  derived and/or modified sequence opt3 from neuraminidase__InfluenzaB__AEQ39455

SEQ ID NO: 150904 - RNA, 1401 nt, Artificial Sequence
  derived and/or modified sequence opt3 from neuraminidase__InfluenzaB__AEQ39466
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaucaaaggauggcaucuaaaguuggucggugguacucccguacuaugucaaagaccgagcgcauggggaugggccucuaugugaaauacgacggagaucccugggcugacagugaugcccuugcuuucagcggcgucaugguguccaugaaggaaccggggugguacucuuuuggauucgagauuaaggacaaaaagugcgaugugccuuguaucgguauagaaaugguccacgacggcgggaaagagacauggcauagcgccgcaacugccauuuauugccugaugggaucaggccaguugcuaugggauaccguuacagguguggacauggcucuguga

SEQ ID NO: 150905 - RNA, 1401 nt, Artificial Sequence; identical to SEQ ID NO: 150891
  derived and/or modified sequence opt3 from neuraminidase__InfluenzaB__AEQ39477

SEQ ID NO: 150906 - RNA, 1401 nt, Artificial Sequence
  derived and/or modified sequence opt3 from neuraminidase__InfluenzaB__AEQ39488
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucucggaucggucguugguacucccgcacuaugucaaagaccgaaagaauggggaugggccucuaugugaaauacgacggagaccccuggacagauagugacgcacuugcuuucagcggcgucaugguguccaugaaggagccggggugguacucuuuuggauucgaaauuaaggauaaaaagugcgacgugccuuguaucgguauagagaugguccacgauggcgggaaagaaacuuggcauagcgccgcuaccgccauuuauugccugaugggaucaggccaguugcuaugggacacaguuaccgguguggauauggcacuguga

SEQ ID NO: 150907 - RNA, 1401 nt, Artificial Sequence; identical to SEQ ID NO: 150857
  derived and/or modified sequence opt3 from neuraminidase__InfluenzaB__AEQ39499

SEQ ID NO: 150908 - RNA, 1401 nt, Artificial Sequence; identical to SEQ ID NO: 150703
  derived and/or modified sequence opt3 from neuraminidase__InfluenzaB__AEQ39510

SEQ ID NO: 150909 - RNA, 1401 nt, Artificial Sequence
  derived and/or modified sequence opt3 from neuraminidase__InfluenzaB__AEQ49685
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccugggcagacagugaugcucuugccuucagcggcgucaugguguccaugaaggagccggggugguacucuuuuggauucgaaauuaaagacaagaaaugcgaugugccuuguaucgguauagagaugguccacgacggcgggaaggaaacauggcauagcgcugccacugcaauuuauugccugaugggaucaggccaguugcuaugggauaccguuacagguguggacauggaucuguga

SEQ ID NO: 150910 - RNA, 1401 nt, Artificial Sequence
  derived and/or modified sequence opt3 from neuraminidase__InfluenzaB__AEQ49686
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuucucaaaauacgcgaggggagaauuaucaaggagauuuucccuaccggaagggucaagcacacggaagaguguacuugcggcuuugcuaguaacaaaacaaucgaaugugccugccgggauaauucuuacaccgcgaagcgcccauucgugaaacugaacguagagacugacacagccgaaauccgauuaaugugcaccgauacguaucuggacacccccagaccugaugacggcuccauuacagggccaugugagagcaauggagacaaggguucgggcgggauaaaaggaggcuuuguucaucaaaggauggagucuaagaucggucggugguacucccguacuaugucaaaaaccgaacgcauggggaugggccucuaugugaaguacgauggagaccccugggcagauagugacgcucuugccuucagcggcgucaugguguccaugaaggagccggggugguacucuuuuggauucgaaauuaaagauaagaaaugcgacgugccuuguaucgguauagagaugguccacgauggcgggaaggaaacauggcauagcgcugccacugcaauuuauugccugaugggaucaggccaguugcuaugggacaccguuacagguguggauauggcccuguga

SEQ ID NO: 150911 - RNA, 1401 nt, Artificial Sequence
  derived and/or modified sequence opt3 from neuraminidase__InfluenzaB__AEQ49687
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguauagagaugguccacgauggcgggaaggaaacauggcauagcgcugccacugcaauuuauugccugaugggaucaggccaguugcuaugggacaccguuacagguguggauauggcccuguga

SEQ ID NO: 150912 - RNA, 1401 nt, Artificial Sequence
  derived and/or modified sequence opt3 from neuraminidase__InfluenzaB__AEQ49688
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauugggaugcgcaaacgccucgaauguucaagcggugaacaggucagcuacuaaagguguaacccuccugcugccggaacccgaguggacauauccucggcucagcuguccaggcaguaccuuccagaaggccuuacugauuucuccccaccgcuuuggggaaacuaaaggaaauuccgcaccucuuaucauucgagagccauucaucgccugcggccccaaggaauguaaacauuuugcuuugacacacuacgcagcccagccugguggguauuacaacggaacccgugaggauagaaauaagcugaggcaucuaauaagcgugaagcucggcaaaaucccaacggucgagaacuccauuuuccacauggcugccuggucaggcagugcgugccaugacgggcgggaauggacuuauaucggaguggaugguccggacagcaaugcacugcuuaagauuaaauacggcgaggccuacaccgauacauaucacucuuacgcuaagaacauccugcgcacucaggaauccgccuguaauugcauagggggagacuguuauuugaugauuaccgauggccccgcaucagguaucagcgagugcagauuucucaaaauuagggaggggcggaucaucaaggaaauuuucccuacaggacgcguuaagcacaccgaggaauguacgugcggcuuugcuaguaacaaaacuauagagugugccugccgagacaauucuuacacagcgaagagaccauucgugaaacugaacgucgaaaccgauacugccgagaucagguuaaugugcacagagaccuaucuggacacgccccggccuaaugauggcuccauuaccgggccaugugaaagcaacggagacaaggguucgggcgggaucaaaggaggcuuugugcaucaacguauggcaucuaagauaggucgcugguacuccagaacaaugucaaaaacuaagaggauggggaugggccucuauguaaaguacgauggagaccccuggaccgacagugaggcucuugcccugagcggcguuaugguguccauggaggaaccggggugguacucuuucggauuugaaauuaaagauaagaaaugcgacgucccuuguaucgguaucgagauggugcacgauggcgggaagacaacuuggcauagcgcugccaccgcaauuuauugcuugaugggaucaggccagcuacugugggacacagugaccggugucaauaugacucucuga

SEQ ID NO: 150913 - RNA, 1401 nt, Artificial Sequence
  derived and/or modified sequence opt3 from neuraminidase__InfluenzaB__AEQ49691
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacagggguucgggcgggauaaagggaggcuucguucaucaacggauggagucuaaaaucggucguugguacucccgcacuaugucaaagaccgaaagaauggggaugggccucuaugugaaauacgauggagacccaugggcagauagugacgcucuugccuuuagcggcgucaugguguccaugaaggagcccgggugguacucuuucggauucgaaauuaaggauaaaaagugcgacgugccguguaucgguauagagaugguccacgauggcgggaaagaaacauggcauagcgcugccacugcaauuuauugccugaugggaucaggccaguugcuaugggacaccguuacagguguggauauggcccuguga

SEQ ID NO: 150914 - RNA, 1401 nt, Artificial Sequence
  derived and/or modified sequence opt3 from neuraminidase__InfluenzaB__AEQ49692
augcugcccagcaccauccagacacucacucuuuuccugacguccggcgggguguuguuaucucuguacgucucagccagucuaagcuaucuccuguacuccgacauucuucugaaguuuucuccuaccgagacaacugcuccaaccaugucguuggauugcgcaaacgccucaaauguucaagcggugaacagaagcgcuacaaaaggaguaaccuuccuccugccggaacccgaguggacuuauccuaggcugaguuguccagguuccacauuucagaaggcccucuuaauaucuccccaccgguucggcgaaaccaaagggaauagcgcaccucugaucauucgcgagccauuuaucgccugcggacccaacgaauguaagcauuucgcucuuacgcacuacgcagcccagccuggcgguuauuacaaugggacucgaggagaccguaacaaauugagacaucugauuuccgugaagcuaggcaagaucccaaccgucgaaaauucaauauuucacauggcugccuggaguggcagcgcgugccaugaugggaaagaguggacauauaucggaguggacgguccggauaacgacgcacuccugaagguuaaauacggcgaggccuacacugauaccuaucacucuuacgcuaauaagauucuuaggacacaggaguccgccuguaacugcaucgggggaaauuguuaucugaugauuaccgacggcucagcaagcggugugagugaaugccgguucuugaaaauccgcgaggggagaauaauuaaggagaucuuucccacgggaagggucaagcacacugaagaguguacaugcggcuucgcuucuaacaaaaccauugaaugugccugccgggauaauuccuacacugcgaagcgcccuuuugugaaacucaacguagagacagacaccgccgaaauccgacugaugugcacggauaccuauuuagacacaccaagacccgaugacggcagcaucacugggccuugugagucgaauggagacaaggguucuggcgggauuaaaggaggcuucguucaucaaaggauggaguccaagauaggucggugguacucacguaccaugaguaaaacagaacgcauggggaugggccuguaugugaaguacgauggagacccaugggcagauagcgacgcucucgccuuuuccggcgucauggugucuaugaaggagcccgggugguacagcuucggauucgaaaucaaagauaagaaaugcgacgugccguguauugguaucgagaugguccacgauggcgggaaggaaacuuggcauucagcugccaccgcaauauauugccuuaugggaaguggccagcuguugugggacacaguuaccgguguggauauggcccuauga

SEQ ID NO: 150915 - RNA, 1401 nt, Artificial Sequence
  derived and/or modified sequence opt3 from neuraminidase__InfluenzaB__AEQ49693
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaaucggacaaucgaaugugccugccgcgacaacucuuacaccgcgaaacgaccauucgugaagcugaauguagagacugauacagccgaaaucagauuaaugugcaccgacacguaucuggauacccccaggccuaacgacggcuccauuacagggccaugugagagcgauggagacaaagguucgggcgggauaaagggaggcuuuguucaucaacggauggagucuaaaaucggucguugguacucccgcacuaugucaaagaccgaaagaauggggaugggccucuaugugaaauacgacggagaucccugggcagacagugaugcucuugccuucagcggcgucaugguguccaugaaggagccggggugguacucuuuuggauucgaaauuaaggacaaaaagugcgaugugccuuguaucgguauagagaugguccacgacggcgggaaagaaacauggcauagcgcugccacugcaauuuauugccugaugggaucaggccaguugcuaugggauaccguuacagguguggacauggcccuguga

SEQ ID NO: 150916 - RNA, 1401 nt, Artificial Sequence
  derived and/or modified sequence opt3 from neuraminidase__InfluenzaB__AEQ49695
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccugggcagacagugaugcucuugccuucagcggcgucaugguguccaugaaggagccggggugguacucuuuuggauucgaaauuaaagacaagaaaugcgaugugccuuguaucgguauagagaugguccacgacggcgggaaggaaacauggcauagcgcugccacugcaauuuauugccugaugggaucaggccaguugcuaugggauaccguuacagguguggacauggcccuguga

SEQ ID NO: 150917 - RNA, 1401 nt, Artificial Sequence
  derived and/or modified sequence opt3 from neuraminidase__InfluenzaB__AEQ49697
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaguaacauuccuccugccggaacccgaguggaccuauccuaggcugaguuguccagguuccacuuuucagaaggcccucuuaaucucuccccaccgguucggcgaaacaaaagggaauagcgcaccucugauuauccgcgagccauuuauugccugcggacccaacgaauguaagcauuucgcucuuacccacuacgcagcccagccuggcgguuauuacaaugggacgcgaggagaccguaacaaauugagacaucugaucuccgugaagcuaggcaagauaccaacugucgaaaauucaaucuuucacauggcugccuggaguggcagcgcgugccaugaugggaaagaguggaccuauauuggaguggacgguccggauaacgacgcacuccugaagguuaaauacggcgaggccuacacagauacuuaucacucuuacgcuaauaagauccuuaggacccaggaguccgccuguaacugcauugggggaaauuguuaucugaugaucacagacggcucagcaagcggugugagugaaugccgguucuugaaaauacgcgaggggagaauuaucaaggagauuuuucccaccggaagggucaagcacacggaagaguguacuugcggcuucgcuucuaacaaaacaaucgaaugugccugccgggauaauuccuacaccgcgaagcgcccuuuugugaaacucaacguagagacugacacagccgaaauccgacugaugugcaccgauacguauuuagacaccccaagacccgaugacggcagcauuacagggccuugugagucgaauggagacaaggguucuggcgggauaaaaggaggcuucguucaucaaaggauggaguccaagaucggucggugguacucacguacuaugaguaaaaccgaacgcauggggaugggccuguaugugaaguacgauggagacccaugggcagauagcgacgcucucgccuuuuccggcgucauggugucuaugaaggagcccgggugguacagcuucggauucgaaauuaaagauaagaaaugcgacgugccguguaucgguauagagaugguccacgauggcgggaaggaaacauggcauucagcugccacugcaauuuauugccuuaugggaaguggccagcuguugugggacaccguuacagguguggauauggcccuauga

SEQ ID NO: 150918 - RNA, 1401 nt, Artificial Sequence; identical to SEQ ID NO: 150917
  derived and/or modified sequence opt3 from neuraminidase__InfluenzaB__AEQ49698

SEQ ID NO: 150919 - RNA, 1401 nt, Artificial Sequence; identical to SEQ ID NO: 150917
  derived and/or modified sequence opt3 from neuraminidase__InfluenzaB__AEQ49699

SEQ ID NO: 150920 - RNA, 1401 nt, Artificial Sequence; identical to SEQ ID NO: 150917
  derived and/or modified sequence opt3 from neuraminidase__InfluenzaB__AEQ49700

SEQ ID NO: 150921 - RNA, 1401 nt, Artificial Sequence; identical to SEQ ID NO: 150914
  derived and/or modified sequence opt3 from neuraminidase__InfluenzaB__AEQ49701

SEQ ID NO: 150922 - RNA, 1401 nt, Artificial Sequence; identical to SEQ ID NO: 150917
  derived and/or modified sequence opt3 from neuraminidase__InfluenzaB__AEQ49702

SEQ ID NO: 150923 - RNA, 1401 nt, Artificial Sequence; identical to SEQ ID NO: 150914
  derived and/or modified sequence opt3 from neuraminidase__InfluenzaB__AEQ49703

SEQ ID NO: 150924 - RNA, 1401 nt, Artificial Sequence; identical to SEQ ID NO: 150917
  derived and/or modified sequence opt3 from neuraminidase__InfluenzaB__AEQ49705

SEQ ID NO: 150925 - RNA, 1401 nt, Artificial Sequence
  derived and/or modified sequence opt3 from neuraminidase__InfluenzaB__AEQ49706
augcugcccagcaccauccagaugcucacacuuuuccugacuuugggcgggguguuacugucccuauacgucucugccucacucaguuaucugcuuuaccuggacauuuugcucaaguuuccuccaacggagauaaccgcuccgacaaugccccuggauugcgcaaacgccagcaauguucaagcggugaacagauccgcuacuaaaggaguaaccuuccugcucccugaaccagaguggacauaucccagguuaucuuguccugguucgaccuuucagaaggcccugcuuaucucaccacaccgguucggcgaaacuaaagggaauagcgcacccuugauuauccgcgagccuuuuauugccugcggaccaaaggaauguaaacauuucgcucugacacacuacgcagcccagccgggcgguuauuacaacgggacccgaggagaccguaauaagcuaagacaucucaucagugugaagcugggcaaaauacccacggucgagaacuccaucuuucacauggcugccuggucuggcagcgcgugccaugaugggaaggaguggacuuauauuggaguggacgguccugauaauaacgcacuucugaaaaucaaguacggcgaagccuucaccgacacauaccacuccuaugcuaauaacauuuugaggacucaggagucagccuguaauugcaucgggggaaacuguuaccucaugauaaccgauggcagugcaagcgguguuucugaaugccgguuucugaaaauucgcgaggggagaaucauuaaggagaucuucccaacaggaagggugaagcacaccgaagaguguacgugcggcuuugcuuccaauaaaacuaucgaaugugccugccgggacaacucauauacagcgaagcgccccuucgucaaauuaaauguggagaccgauacugccgaaauucgacugaugugcacagacaccuaccucgauacgccuagaccagacgauggcagcauaaccgggcccugugagaguaacggagacaaggguucuggcgggaucaaaggaggcuuuguacaucaaaggauggcauccaagauuggucggugguauagccguacaaugucgaaaacugagcgcauggggaugggccuuuacguuaaguaugacggagauccgugggcugacucugaugcccuggcuuucuccggcgugauggucucaaugaaggaaccugggugguacaguuucggauuugagaucaaagacaagaaaugcgaugugcccuguauagguauugaaauggugcacgacggcgggaaggagaccuggcauagcgccgcaacagccaucuacugcuugaugggauccggccagcuacugugggauacugucaccgguguuaacauggcucucuga

SEQ ID NO: 150926 - RNA, 1401 nt, Artificial Sequence; identical to SEQ ID NO: 150917
  derived and/or modified sequence opt3 from neuraminidase__InfluenzaB__AEQ49707

SEQ ID NO: 150927 - RNA, 1401 nt, Artificial Sequence; identical to SEQ ID NO: 150917
  derived and/or modified sequence opt3 from neuraminidase__InfluenzaB__AEQ49708

SEQ ID NO: 150928 - RNA, 1401 nt, Artificial Sequence
  derived and/or modified sequence opt3 from neuraminidase__InfluenzaB__AEQ49709
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguauagagaugguccacgauggcgggaaggaaacauggcauagcgcugccacugcaauuuauugccugaugggaucaggccacuugcuaugggacaccguuacagguguggauauggcccuguga

SEQ ID NO: 150929 - RNA, 1401 nt, Artificial Sequence; identical to SEQ ID NO: 150891
  derived and/or modified sequence opt3 from neuraminidase__InfluenzaB__AEQ49710

SEQ ID NO: 150930 - RNA, 1401 nt, Artificial Sequence; identical to SEQ ID NO: 150888
  derived and/or modified sequence opt3 from neuraminidase__InfluenzaB__AER27042

SEQ ID NO: 150931 - RNA, 1401 nt, Artificial Sequence; identical to SEQ ID NO: 150916
  derived and/or modified sequence opt3 from neuraminidase__InfluenzaB__AER27053

SEQ ID NO: 150932 - RNA, 1401 nt, Artificial Sequence; identical to SEQ ID NO: 150888
  derived and/or modified sequence opt3 from neuraminidase__InfluenzaB__AER27064

SEQ ID NO: 150933 - RNA, 1401 nt, Artificial Sequence; identical to SEQ ID NO: 150891
  derived and/or modified sequence opt3 from neuraminidase__InfluenzaB__AET43128

SEQ ID NO: 150934 - RNA, 1401 nt, Artificial Sequence; identical to SEQ ID NO: 150891
  derived and/or modified sequence opt3 from neuraminidase__InfluenzaB__AET43139

SEQ ID NO: 150935 - RNA, 1401 nt, Artificial Sequence
  derived and/or modified sequence opt3 from neuraminidase__InfluenzaB__AET43150
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaaccugaguggacauauccaagacucagcugucccgguaguaccuuccagaaagccuuacugaucuccccucauagguuuggcgaaacuaagggaaauucugcaccacuuauuauccgggagcccuucauugccugcgggccuaacgaauguaaacacuuugcuuugacacauuacgcagcccagccaggcgguuauuacaaugggacccgcggagaccgaaacaagcugcgucaccuaaucagcgugaagcucggcaaaauaccgacggucgaaaauuccaucuuccauauggcugccuggucaggcagugcgugccacgaugggaaggaguggacuuauauuggaguggacggucccgauaacaaugcacugcuuaaaguuaaguacggcgaggccuacaccgacacauaucacagcuacgcuaacaaaauccugagaacucaggagucugccuguaauugcauugggggaaacuguuauuugaugaucaccgauggcuccgcaucaggugugagcgaaugcagguuucucaagauacgggaggggcgcauuaucaaggagauuuucccuacaggaagagucaaacauaccgaagaguguacgugcggcuuugcuaguaauaagacuaucgaaugugccugcagggacaacucuuacacagcgaaacggccauucgugaagcugaauguagagaccgauacugccgaaauccgcuuaaugugcacagacaccuaucuggauacgccccgaccugacgauggcuccauuaccgggccaugugagagcaacggagacaaagguucgggcgggauaaagggaggcuuuguucaccaaagaauggagucuaaaaucgguaggugguacucccggacaaugucaaagacugaacguauggggaugggccucuaugugaaguacgacggagaucccugggcagacagugaugcucuuaccuucagcggcgucaugguguccaugaaagagccggggugguacucuuuuggauucgaaauuaaggacaaaaagugcgaugugccuuguaucgguauagagaugguccaugacggcgggaaagaaacauggcacagcgccgcuacugccauuuauugccugaugggaucaggccaguugcuaugggauaccguuacagguguggacauggcacuguga

SEQ ID NO: 150936 - RNA, 1401 nt, Artificial Sequence; identical to SEQ ID NO: 150891
  derived and/or modified sequence opt3 from neuraminidase__InfluenzaB__AET43161

SEQ ID NO: 150937 - RNA, 1401 nt, Artificial Sequence; identical to SEQ ID NO: 150891
  derived and/or modified sequence opt3 from neuraminidase__InfluenzaB__AET43172

SEQ ID NO: 150938 - RNA, 1401 nt, Artificial Sequence; identical to SEQ ID NO: 150891
  derived and/or modified sequence opt3 from neuraminidase__InfluenzaB__AET43183

SEQ ID NO: 150939 - RNA, 1401 nt, Artificial Sequence; identical to SEQ ID NO: 150891
  derived and/or modified sequence opt3 from neuraminidase__InfluenzaB__AET43194

SEQ ID NO: 150940 - RNA, 1401 nt, Artificial Sequence; identical to SEQ ID NO: 150891
  derived and/or modified sequence opt3 from neuraminidase__InfluenzaB__AET43216

SEQ ID NO: 150941 - RNA, 1401 nt, Artificial Sequence; identical to SEQ ID NO: 150891
  derived and/or modified sequence opt3 from neuraminidase__InfluenzaB__AET43227

SEQ ID NO: 150942 - RNA, 1401 nt, Artificial Sequence
  derived and/or modified sequence opt3 from neuraminidase__InfluenzaB__AET50947
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaaccugaguggacauauccaagacucagcugucccgguaguaccuuccagaaagccuuacugaucuccccucauagguuuggcgaaacuaagggaaauucugcaccacuuauuauccgggagcccuucauugccugcgggccuaacgaauguaaacacuuugcuuugacacauuacgcagcccagccaggcgguuauuacaaugggacccgcggagaccgaaacaagcugcgucaccuaaucagcgugaagcucggcaaaauaccgacggucgaaaauuccaucuuccauauggcugccuggucaggcagugcgugccacgaugggaaggaguggacuuauauuggaguggacggucccgauaacaaugcacugcuuaaaguuaaguacggcgaggccuacaccgacacauaucacagcuacgcuaacaaaauccugagaacucaggagucugccuguaauugcauugggggaaacuguuauuugaugaucaccgauggcuccgcaucaggugugagcgaaugcagguuucucaagauacgggaggggcgcauuaucaaggagauuuucccuacaggaagagucaaacauaccgaagaguguacgugcggcuuugcuaguaauaagacuaucgaaugugccugcagggacaacucuuacacagcgaaacggccauucgugaagcugaauguagagaccgauacugccgaaauccgcuuaaugugcacagacaccuaucuggauacgccccgaccugacgauggcuccauuaccgggccaugugagagcaacggagacaaagguucgggcgggauaaagggaggcuuuguucaccaaagaauggagucuaaaaucgguaggugguacucccggacaaugucaaagacugaacguauggggaugggccucuaugugaaguacgacggagaucccugggcagacagugaugcucuugccuucagcggcgucaugauuuccaugaaagagccggggugguacucuuuuggauucgaaaucaaggacaaaaagugcgaugugccuuguauagguauugagauggugcaugacggcgggaaagaaaccuggcacagcgcugccacagcaaucuauugccugaugggaucaggccaguugcuaugggauacugucaccgguguugacauggcccuguga

SEQ ID NO: 150943 - RNA, 1401 nt, Artificial Sequence
  derived and/or modified sequence opt3 from neuraminidase__InfluenzaB__AET50958
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaacucgaguggacauauccuagauuaagcuguccagguaguaccuuccagaaagcccugcuuaucucuccccauagguuuggcgaaacuaagggaaauuccgcaccuuugauuauccgggagccauucauugccugcgggcccaacgaauguaaacacuuugcucugacacauuacgcagcccagccuggcgguuauuacaaugggacccgcggagaccgaaacaagcuacgucaccucaucagcgugaagcugggcaaaauaccaacggucgaaaauuccaucuuccauauggcugccuggucaggcagugcgugccacgaugggaaggaguggacuuauauuggaguggacgguccggauaacaaugcacuucugaaaguuaaguacggcgaggccuacaccgacacauaucacagcuacgcuaacaaaaucuugagaacucaggagucugccuguaauugcauugggggaaacuguuaucucaugaucaccgauggcuccgcaucaggugugagcgaaugcagguuucugaagauacgggaggggcgcauuaucaaggagauuuuccccacaggaagagucaaacauaccgaagaguguacgugcggcuuugcuaguaauaagacuaucgaaugugccugcagggacaacucuuacacagcgaaacggccuuucgugaaguuaaauguagagaccgauacugccgaaauccgccugaugugcacagacaccuaucucgauacgccacgacccgacgauggcuccauuaccgggccuugugagagcaacggagacaaagguucgggcgggauaaagggaggcuuuguucaccaaagaauggagucuaaaaucgguaggugguacucccggacaaugucaaagacugaacguauggggaugggccuuuaugugaaguacgacggagauccaugggcagacagugaugcucuggccuucagcggcgucaugguguccaugaaagagcccgggugguacucuuuuggauucgaaauuaaggacaaaaagugcgaugugccguguaucgguauagagaugguccaugacggcgggaaagaaaccuggcacagcgcugccacagcaauuuauugcuugaugggaucaggccagcuacugugggauacuguuaccgguguggacauggcccucuga

SEQ ID NO: 150944 - RNA, 1401 nt, Artificial Sequence; identical to SEQ ID NO: 150891
  derived and/or modified sequence opt3 from neuraminidase__InfluenzaB__AET50969

SEQ ID NO: 150945 - RNA, 1401 nt, Artificial Sequence; identical to SEQ ID NO: 150891
  derived and/or modified sequence opt3 from neuraminidase__InfluenzaB__AET50980

SEQ ID NO: 150946 - RNA, 1401 nt, Artificial Sequence; identical to SEQ ID NO: 150891
  derived and/or modified sequence opt3 from neuraminidase__InfluenzaB__AET74259

SEQ ID NO: 150947 - RNA, 1401 nt, Artificial Sequence; identical to SEQ ID NO: 150891
  derived and/or modified sequence opt3 from neuraminidase__InfluenzaB__AET74270

SEQ ID NO: 150948 - RNA, 1401 nt, Artificial Sequence; identical to SEQ ID NO: 150942
  derived and/or modified sequence opt3 from neuraminidase__InfluenzaB__AET74281

SEQ ID NO: 150949 - RNA, 1401 nt, Artificial Sequence; identical to SEQ ID NO: 150891
  derived and/or modified sequence opt3 from neuraminidase__InfluenzaB__AET74292

SEQ ID NO: 150950 - RNA, 1401 nt, Artificial Sequence; identical to SEQ ID NO: 150891
  derived and/or modified sequence opt3 from neuraminidase__InfluenzaB__AET74303

SEQ ID NO: 150951 - RNA, 1401 nt, Artificial Sequence; identical to SEQ ID NO: 150891
  derived and/or modified sequence opt3 from neuraminidase__InfluenzaB__AET74314

SEQ ID NO: 150952 - RNA, 1401 nt, Artificial Sequence; identical to SEQ ID NO: 150891
  derived and/or modified sequence opt3 from neuraminidase__InfluenzaB__AET74333

SEQ ID NO: 150953 - RNA, 1401 nt, Artificial Sequence
  derived and/or modified sequence opt3 from neuraminidase__InfluenzaB__AET74344
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaaccugaguggacauauccaagacucagcugucccgguaguaccuuccagaaagccuuacugaucuccccucauagguuuggcgaaacuaagggaaauucugcaccacuuauuauccgggagcccuucauugccugcgggccuaacgaauguaaacacuuugcuuugacacauuacgcagcccagccaggcgguuauuacaaugggacccgcggagaccgaaacaagcugcgucaccuaaucagcgugaagcucggcaaaauaccgacggucgaaaauuccaucuuccauauggcugccuggucaggcagugcgugccacgaugggaaggaguggacuuauauuggaguggacggucccgauaacaaugcacugcuuaaaguuaaguacggcgaggccuacaccgacacauaucacagcuacgcuaacaaaauccugagaacucaggagucugccuguaauugcauugggggaaacuguuauuugaugaucaccgauggcuccgcaucaggugugagcgaaugcagguuucucaagauacgggaggggcgcauuaucaaggagauuuucccuacaggaagagucaaacauaccgaagaguguacgugcggcuuugcuaguaauaagacuaucgaaugugccugcagggacaacucuuacacagcgaaacggccauucgugaagcugaauguagaggccgauaccgcagaaauccgcuuaaugugcacugacacauaucuggauacgccccgaccugacgauggcuccauuaccgggccaugugagagcaacggagacaaagguucgggcgggauaaagggaggcuuuguucaccaaagaauggagucuaaaaucgguaggugguacucccggaccaugucaaagacagaacguauggggaugggccucuaugugaaguacgacggagaucccugggcugacagugaugcccuugcuuucagcggcgucaugguguccaugaaagagccggggugguacucuuuuggauucgaaauuaaggacaaaaagugcgaugugccuuguaucgguauagagaugguccaugacggcgggaaagaaacuuggcacagcgccgcaaccgccauuuauugccugaugggaucaggccaguugcuaugggauacaguuacugguguggacauggcucuguga

SEQ ID NO: 150954 - RNA, 1401 nt, Artificial Sequence; identical to SEQ ID NO: 150891
  derived and/or modified sequence opt3 from neuraminidase__InfluenzaB__AET74355

SEQ ID NO: 150955 - RNA, 1404 nt, Artificial Sequence
  derived and/or modified sequence opt3 from neuraminidase__InfluenzaB__AEY75594
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcugcccgaaccugaguggacauauccaaggcucagcugucccgguaguaccuuucaaaaggccuuacugaucuccccucaucgguucggcgaaacuaaaggaaauucugcaccacuuauuauccgcgagcccuuuauugccugcgggccuaacgaauguaagcacuucgcuuugacacauuacgcagcccagccaggcgguuauuacaaugggacccgaggagaccguaacaaacugagacaccuaaucagcgugaagcucggcaagauaccgacggucgaaaauuccaucuuucauauggcugccuggucaggcagugcgugccacgaugggaaagaguggacuuauauuggaguggacggucccgauaacaaugcacugcuuaagaucaaauacggcgaggccuacaccgacacauaucacagcuacgcuaacaauauucugaggacucaggagucugccuguaacugcaucgggggaaauuguuauuugaugauaaccgauggcuccgcaucagguguuagcgaaugccgguuccucaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcugaacguggagaccgauacugccgaaauucgauuaaugugcacagacaccuaucuggauacgcccagaccugacgauggcuccauaaccgggccaugugagagcaacggagacaaagguucgggcgggacaaagggaggcuucguacaccagaggauggcaucuaaaaucggucggugguacucccguacuaugucaaagaccgagcgcaaagggaugggccucuauguuaaguacgacggagaucccuggacagacagugaugcucuugccuuuagaggcgugauggucagcaugaaggaaccggggugguacuccuucggauucgagauuaaagacaagaaaugcgaugugccuuguaucgguauagaaauggugcaugacggcgggaaggagacuuggcacucugcugccaccgcaauuuauugccugaugggaagcggccaauugcuaugggauacagucaccgguguugacauggcccuguga

SEQ ID NO: 150956 - RNA, 1401 nt, Artificial Sequence
  derived and/or modified sequence opt3 from neuraminidase__InfluenzaB__AFA45223
augcugcccagcaccauccagacacucacucuuuuccugacguccggcgggguguuguuaucucuguacgucucagcccuacucaguuaucugcuuuacagcgacauucugccuaaguuuuccccaaccgagauaacagcuccgacuaugucuuuggauugcgcaaacgccucgaauguucaagcggugaacagaucagcuaccaaaggaguaacauuccuccugagcgaacccgaguggaccuauccuaggcugaguuguccagguuccacuuuucagaaggcccucuuaaucucuccccaccgguucggcgaaacaaaagggaauagcgcaccucugauuauccgcgagccauuuauugccugcggacccaacgaauguaagcauuucgcucuuacccacuacgcagcccagccuggcgguuauuacaaugggacgcgaggagaccguaacaaauugagacaucugaucuccgugaagcuaggcaagauaccaacugucgaaaauucaaucuuucacauggcugccuggaguggcagcgcgugccaugaugggaaagaguggaccuauauuggaguggacgguccggauaacgacgcacuccugaagguuaaauacggcgaggccuacacagauacuuaucacucuuacgcuaauaagauccuuaggacccaggaguccgccuguaacugcauugggggaaauuguuaucugaugaucacagacggcucagcaagcggugugagugaaugccgguucuugaaaauacgcgaggggagaauuaucaaggagauuuuucccaccggaagggucaagcacacggaagaguguacuugcggcuucgcuucuaacaaaacaaucgaaugugccugccgggauaauuccuacaccgcgaagcgcccuuuugugaaacucaacguagagacugacacagccgaaauccgacugaugugcaccgauacguauuuagacaccccaagacccgaugacggcagcauuacagggccuugugagucgaauggagacaaggguucuggcgggauaaaaggaggcuucguucaucaaaggauggaguccaagaucggucggugguacucacguacuaugaguaaaaccgaacgcauggggaugggccuguaugugaaguacgauggagacccaugggcagauagcgacgcucucgccuuuuccggcgucauggugucuaugaaggagcccgggugguacagcuucggauucgaaauuaaagauaagaaaugcgacgugccguguaucgguauagagaugguccacgauggcgggaaggaaacauggcauucagcugccacugcaauuuauugccuuaugggaaguggccagcuguugugggacaccguuacagguguggauauggcccuauga

SEQ ID NO: 150957 - RNA, 1401 nt, Artificial Sequence
  derived and/or modified sequence opt3 from neuraminidase__InfluenzaB__AFA45226
augcugcccagcaccauccagacacucacucuuuuccugacguccggcgggguguuguuaucucuguacgucucagccagucuaagcuaucuccuguacuccgacauucuucugaaguuuucuccuaccgagacaacugcuccaaccaugucguuggauugcgcaaacgccucaaauguucaagcggugaacagaagcgcuacaaaaggaguaaccuuccuccugccggaacccgaguggacuuauccuaggcugaguuguccagguuccacauuucagaaggcccucuuaauaucuccccaccgguucggcgaaaccaaagggaauagcgcaccucugaucauucgcgagccauuuaucgccugcggacccaacgaauguaagcauuucgcucuuacgcacuacgcagcccagccuggcgguuauuacaaugggacucgaggagaccguaacaaauugagacaucugauuuccgugaagcuaggcaaggucccaaccguggaaaauucaaucuuucacauggcugccuggaguggcagcgcgugccaugaugggaaagaguggacauauauaggaguugacgguccggauaacgacgcacuccugaaggugaaauacggcgaggccuacacugauaccuaucacucuuacgcuaauaagauccuuaggacacaggaguccgccuguaacugcauugggggaaauuguuaucugaugaucaccgacggcucagcaagcggugucagugaaugccgguucuugaaaauucgcgaggggagaaucauaaaggagauuuuucccacgggaagggugaagcacacugaagaguguacaugcggcuucgcuucuaacaaaaccaucgaaugugccugccgggauaauuccuacacugcgaagcgcccuuuuguaaaacucaacguugagacagacaccgccgaaauucgacugaugugcacggauaccuauuuagacacaccaagacccgaugacggcagcaucacugggccuugugagucgaauggagacaaggguucuggcgggaucaaaggaggcuucgugcaucaaaggauggaguccaagauuggucggugguacucacguaccaugaguaaaacagaacgcauggggaugggccuguaugucaaguacgauggagacccaugggcagauagcgacgcucucgccuuuuccggcgugauggugucuaugaaggagcccgggugguacagcuucggauucgaaauaaaagauaagaaaugcgacgucccguguaucgguauugagaugguucacgauggcgggaagggaacuuggcauucagcugccaccgcaaucuauugccuuaugggcaguggucagcuguugugggacacagugaccgggguagauauggcccuauga

SEQ ID NO: 150958 - RNA, 1401 nt, Artificial Sequence
  derived and/or modified sequence opt3 from neuraminidase__InfluenzaB__AFA45229
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugccgcucgauugcgcaaacgccucuaauguucaagcggugaacagaucggcuaccaaaggaguaacauuccugcugcccgaaccugaguggaccuauccaaggcucucaugucccgguagcacuuuucagaaggccuuacugaucaguccucaccgguucggcgaaacaaaaggaaauuccgcaccacuuauuauccgcgagcccuuuauugccugcgggccuaacgaauguaagcauuucgcuuugacccacuacgcagcccagccaggcgguuauuacaaugggacgcgaggagaccguaacaaacugagacaucuaaucucugugaagcucggcaagauaccgacugucgagaauagcaucuuucacauggcugccugguccggcucagcgugccaugaugggaaagaguggaccuauauuggaguggacggucccgauaacgacgcacugcuuaagguuaaauacggcgaagccuacacagauacuuaucacaguuacgcuaauaagauccugaggacccaggagagcgccuguaacugcauugggggaaauuguuauuugaugaucacagacggcucugcauccggugugucagaaugccgguuccucaaaauacgcgaggggagaauuaucaaggagauuuuuccuaccggaagggucaagcacacggaagaguguacuugcggcuucgcuagcaacaaaacaaucgaaugugccugccgggauaauaguuacaccgcgaagcgcccauuugugaaacugaacguagagacugacacagccgaaauccgauuaaugugcaccgauacguaucuggacacccccagaccugaugacggcucuauuacagggccaugugaguccaauggagacaaggguagcggcgggauaaaaggaggcuucguucaucaaaggauggagucgaagaucggucggugguacucucguacuauguccaaaaccgaacgcauggggaugggccucuaugugaaguacgauggagaccccugggcagauucagacgcucuugccuuuaguggcgucauggugagcaugaaggagccggggugguacuccuucggauucgaaauuaaagauaagaaaugcgacgugccuuguaucgguauagagaugguccacgauggcgggaaggaaacauggcauucugcugccacugcaauuuauugccugaugggaagcggccaguugcuaugggacaccguuacagguguggauauggcccuguga

SEQ ID NO: 150959 - RNA, 1401 nt, Artificial Sequence; identical to SEQ ID NO: 150911
  derived and/or modified sequence opt3 from neuraminidase__InfluenzaB__AFA45235

SEQ ID NO: 150960 - RNA, 1401 nt, Artificial Sequence
  derived and/or modified sequence opt3 from neuraminidase__InfluenzaB__AFA45238
augcugcccagcaccauccagacacucacucuuuuccugacguccggcgggguguuguuaucucuguacgucucagccagucuaagcuaucuccuguacuccgacauucuucugaaguuuucuccuaccaaaacaacugcuccaaccaugucguuggauugcgcaaacgccucaaauguucaagcggugaacagaagcgcuacaaagggaguaaccuuccuccugccggagcccgaauggacuuauccuaggcugaguuguccagguuccacauuucagaaagcccucuuaauaucuccccaccgguucggcgagaccaaggggaauagcgcaccucugaucauucgcgaaccauuuaucgccugcggacccaacgaguguaaacauuucgcucuuacgcacuacgcagcccagccuggcgguuauuacaaugggacucgaggagaccguaacaaguugagacaucugauuuccgugaagcuaggcaaaaucccaaccgucgaaaauucaauauuucacauggcugccuggaguggcagcgcgugccaugaugggaaggaguggacauauaucggaguggacgguccggauaacgacgcacuccugaaaguuaaguacggcgaggccuacacugauaccuaucacucuuacgcuaauaaaauucuuaggacacaggaauccgccuguaacugcaucgggggaaauuguuaucugaugauuaccgacggcucagcaagcggugugagugagugccgguucuugaagauccgcgaagggagaauaauuaaggagaucuuucccacgggaagggucaaacacacugaggaauguacaugcggcuucgcuucuaacaagaccauugagugugccugccgggauaauuccuacacugcgaaacgcccuuuugugaagcucaacguagaaacagacaccgccgagauccgacugaugugcacggauaccuauuuagacacaccaagacccgaugacggcagcaucacugggccuugugaaucgaauggagacaaagguucuggcgggauuaagggaggcuucguucaucaaaggauggaguccaaaauaggucggugguacucacguaccaugaguaagacagagcgcauggggaugggccuguaugugaaguacgauggagacccaugggcagauagcgacgcucucgccuuuuccggcgucauggugucuaugaaagaacccgggugguacagcuucggauucgagaucaaggauaaaaagugcgacgugccguguauugguaucgaaaugguccacgauggcgggaaagagacuuggcauucagcugccaccgcaauauauugccuuaugggaaguggccagcuguugugggacacaguuaccgguguggauauggcccuauga

SEQ ID NO: 150961 - RNA, 1401 nt, Artificial Sequence
  derived and/or modified sequence opt3 from neuraminidase__InfluenzaB__AFA45241
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaaucuuccuccugcccgaaccugaguggacauauccaaggcugagcugucccgguaguaccuuucagaaggcccucuuaauuuccccucaccgguucggcgaaacuaaaggaaauucugcaccacugaucauucgcgagcccuuuaucgccugcgggccuaacgaauguaagcauuucgcucuuacacacuacgcagcccagccaggcgguuauuacaaugggacccgaggagaccguaacaaauugagacaucugauaagcgugaagcuaggcaagaucccgacggucgaaaauuccauuuuucacauggcugccuggucaggcagugcgugccaugaugggaaagaguggacuuauaucggaguggacggucccgauaacaaugcacuccugaagguuaaauacggcgaggccuacaccgacacauaucacagcuacgcuaacaagauucuuaggacucaggagucugccuguaauugcaucgggggaaacuguuaucugaugauaaccgauggcuccgcaucaggugugagcgaaugccgguucuugaaaauucgcgaggggagaaucauuaaggagaucuuuccuacaggaagggucaagcacaccgaagaguguacgugcggcuucgcuaguaauaaaacuaucgaaugugccugccgggacaacucuuacacagcgaagcgcccauuugugaaacucaauguagagaccgauacugccgaaauucgacugaugugcacagacaccuauuuagauacgcccagaccugacgauggcuccauaaccgggccaugugagagcaacggagacaaggguucgggcgggaucaaaggaggcuucguucaucaaaggauggagucuaagauuggucggugguacucccguacaaugucaaaaacugaacgcauggggaugggccuguaugugaaguacgacggagaucccugggcagacagugaugcucucaccuuuagcggcgucaugguguccaugaaggagccggggugguacucuuucggauucgaaaucaaagacaagaaaugcgaugugccuuguauagguauugagaugguccacgacggcgggaaggaaacauggcauagcgccgcuacugccaucuauugccuuaugggaucaggccagcuguugugggauaccguuacagguguggacauggcacuauga

SEQ ID NO: 150962 - RNA, 1401 nt, Artificial Sequence
  derived and/or modified sequence opt3 from neuraminidase__InfluenzaB__AFA45244
augcugcccagcaccauccagacacucacucuuuuccugacguccggcgggguguuguuaucucuguacgucucagccagucuaagcuaucuccuguacuccgacauucuucugaaguuuucuccuaccgagacaacugcuccaaccaugucguuggauugcgcaaacgccucaaauguucaagcggugaacagaagcgcuacaaaaggaguaaccuuccuccugccggaacccgaguggacuuauccuaggcugaguuguccagguuccacauuucagaaggcccucuuaauaucuccccaccgguucggcgaaaccaaagggaauagcgcaccucugaucauucgcgagccauuuaucgccugcggacccaacgaauguaagcauuucgcucuuacgcacuacgcagcccagccuggcgguuauuacaaugggacucgaggagaccguaacaaauugagacaucugauuuccgugaagcuaggcaagaucccaaccgucgaaaauucaauauuucacauggcugccuggaguggcagcgcgugccaugaugggaaagaguggacauauaucggaguggacgguccggauaacgacgcacuccugaagguuaaauacggcgaggccuacacugauaccuaucacucuuacgcuaauaagauucuuaggacacaggaguccgccuguaacugcaucgggggaaauuguuaucugaugauuaccgacggcucagcaagcggugugagugaaugccgguucuugaaaauccgcgaggggagaauaauuaaggagaucuuucccacgggaagggucaagcacacugaagaguguacaugcggcuucgcuucuaacaaaaccauugaaugugccugccgggauaauuccuacacugcgaagcgcccuuuugugaaacucaacguagagacagacaccgccgaaauccgacugaugugcacggauaccuauuuagacacaccaagacccgaugacggcagcaucacugggccuugugagucgaauggagacaaggguucuggcgggauuaaaggaggcuucguucaucaaaggauggaguccaagauaggucggugguacucacguaccaugaguaaaacagaacgcauggggaugggccuguaugugaaguacgauggagacccaugggcagauagcgacgcucucgccuuuuccggcgucauggugucuaugaaggagcccgggugguacagcuucggauucgaaaucaaagauaagaaaugcgacgugccguguauugguaucgagaugguccacgauggcgggaagaaaacuuggcauucagcugccaccgcaauauauugccuuaugggaaguggccagcuguugugggacacaguuaccgguguggauauggcccuauga

SEQ ID NO: 150963 - RNA, 1401 nt, Artificial Sequence
  derived and/or modified sequence opt3 from neuraminidase__InfluenzaB__AFA45247
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaccaaaggaaauuccgcaccucuuauuauccgcgagccauucauugccugcgggcccaacgaauguaagcauuuugcuuugacgcacuacgcagcccagccuggcgguuauuacaaugggacucgaggagaccguaacaaacugagacaucuaaucagcgugaagcucggcaagauaccaaccgucgaaaauuccaucuuccacauggcugccuggucaggcagugcgugccaugaugggaaagaguggacauauauuggaguggacgguccggauaacaaugcacugcuuaagguuaaauacggcgaggccuacacugacaccuaucacagcuacgcuaacaagauccugaggacacaggagucugccuguaauugcauugggggaaacuguuauuugauggugaccgauggcuccgcaucaggugucagcgaaugccgguuucucaaaauccgcgaggggagaauaauuaaggagaucuuccccacgggaagggugaagcacacugaagaguguacaugcggcuuugcuaguaauaaaaccauugaaugugccugccgggacaacucuuacacugcgaagcgcccuuucguaaaacugaauguugagacagauaccgccgaaauccgauuaaugugcacggacaccuaucuggauacaccaagacccgacgauggcuccaucacugggccuugugagagcaacggagacaaggguucgggcgggauuaaaggaggcuuugugcaucaaaggauggagucuaagauaggucggugguacucccguaccaugucaaaaacagaacgcauggggaugggccucuaugucaaguacgacggagauccaugggcagacagugaugcucuuguguucagcggcgugauggucuccaugaaggagcccgggugguacucuuuuggauucgaaaucaaagacaagaaaugcgauguuccguguauugguaucgagauggugcacgacggcgggaaggaaacuuggcauagcgccgcuaccgccauauauugccugaugggaucaggccaguugcuaugggauacaguaaccgguguggacauggcacuguga

SEQ ID NO: 150964 - RNA, 1401 nt, Artificial Sequence; identical to SEQ ID NO: 150914
  derived and/or modified sequence opt3 from neuraminidase__InfluenzaB__AFA45250

SEQ ID NO: 150965 - RNA, 1401 nt, Artificial Sequence
  derived and/or modified sequence opt3 from neuraminidase__InfluenzaB__AFA45253
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugugugccgggauaauucuuacaccgccaagcgcccuuuuguaaaacugaacguugagacugacacagcggaaauccgauuaaugugcaccgauacguaucuggacaccccaagacccgaugacggcuccauuacagggccuugugagagcaauggagacaaggguucgggcgggauaaaaggaggcuucgugcaucaaaggauggagucuaagaucggucggugguacucccguacuaugucaaaaaccgaacgcauggggaugggccucuaugucaaguacgauggagacccaugggccgauagugacgcacuugcuuuuagcggcgugaugguguccaugaaggagcccgggugguacucuuucggauucgaaauuaaagauaagaaaugcgacgucccguguaucgguauagagaugguucacgauggcgggaaggaaacauggcauagcgccgcuacugccauuuauugccugaugggaucaggccaguugcuaugggacaccgugacagguguagauauggcacuguga

SEQ ID NO: 150966 - RNA, 1401 nt, Artificial Sequence
  derived and/or modified sequence opt3 from neuraminidase__InfluenzaB__AFB77645
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaagggucaagcacaccgaagaguguacgugcggcuuugccaguaauaaaacuaucgaaugugcgugccgggacaacucuuacacagccaagcgcccauucgugaaacugaauguagagaccgauacugcagaaauccgauuaaugugcacagacaccuaucuggauacgcccagaccuaacgacggcuccauuaccgggccaugugagagcgauggagacaaggguucgggcgggauaaaaggaggcuuuguucaucaaaggauggagucuaagaucggucggugguacucccguacaaugucaaaaacugaacgcauggggaugggccucuaugugaaguacgacggagaucccugggcugacagugaugcccuugucuucagcggcgugaugguguccaugaaggagccggggugguacucuuuuggauucgaaauuaaagacaagaaaugcgaugucccuuguaucgguauagagaugguucacgacggcgggaaggaaaccuggcauagcgcugccacagcaauuuauugccugaugggaucaggccaguugcuaugggauacugugaccgguguagacauggcccuguga

SEQ ID NO: 150967 - RNA, 1401 nt, Artificial Sequence
  derived and/or modified sequence opt3 from neuraminidase__InfluenzaB__AFB77647
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaucccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugauuuccccucaccgguuuggcgaaacuaaaggaaauucugccccacuuaucauucgcgagcccuucaucgcuugcgggccuaacgaauguaagcauuuugcauugacacacuacgccgcucagccaggcgguuauuacaaugggacccgaggagaccguaacaaacugagacaucuaauaagcgugaagcucggcaagaucccgacggucgaaaauuccauuuuccacauggccgcguggucaggcagugcaugccaugaugggaaagaguggacuuauaucggaguggacggucccgauaacaaugcccugcuuaagguuaaauacggcgaggcuuacaccgacacauaucacagcuacgccaacaagauucugaggacucaggagucugcauguaauugcaucgggggaaacuguuauuugaugauaaccgauggcuccgcuucaggugugagcgaaugccgguuucucaaaauucgcgaggggagaaucauuaaggagaucuucccuacaggaagggucaagcacaccgaagaguguacgugcggcuuugccaguaauaaaacuaucgaaugugcgugccgggacaacucuuacacagccaagcgcccauucgugaaacugaauguagagaccgauacugcagaaauucgauuaaugugcacagacaccuaucuggauacgcccagaccuaacgacggcuccauaaccgggccaugugagagcgauggagacaaggguucgggcgggaucaaaggaggcuuuguucaucaaaggauggagucuaagauuggucggugguacucccguacaaugucaaaaacugaacgcauggggaugggccucuaugugaaguacgacggagaucccugggcugacagugaugcccuugcuuucagcggcgucaugguguccaugaaggagccggggugguacucuuuuggauucgaaaucaaagacaagaaaugcgaugugccuuguauagguauugagaugguccacgacggcgggaaggaaaccuggcauagcgccgcaacagccaucuauugccugaugggaucaggccaguugcuaugggauacuguuaccgguguggacauggcucuguga

SEQ ID NO: 150968 - RNA, 1401 nt, Artificial Sequence
  derived and/or modified sequence opt3 from neuraminidase__InfluenzaB__AFB77649
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaaggaucaagcacaccgaagaguguacgugcggcuuugccaguaauaaaacuaucgaaugugcgugccgggacaacucuuacacagccaagcgcccauucgucaaacugaauguggagaccgauacugcagaaauucgauuaaugugcacagacaccuaucuggauacgcccagaccuaacgacggcuccauaaccgggccaugugagagcgauggagacaaggguucgggcgggaucaaaggaggcuuuguacaucaaaggauggagucuaagauuggucggugguacucccguacaaugucaaaaacugaacgcauggggaugggccucuauguuaaguacgacggagaucccugggcugacagugaugcccuugcuuucagcggcgugauggucuccaugaaggagccggggugguacucuuuuggauucgaaaucaaagacaagaaaugcgaugugccuuguauagguauugagauggugcacgacggcgggaaggaaaccuggcauagcgccgcaacagccaucuauugccugaugggaucaggccaguugcuaugggauacugucaccgguguugacauggcucuguga

SEQ ID NO: 150969 - RNA, 1401 nt, Artificial Sequence
  derived and/or modified sequence opt3 from neuraminidase__InfluenzaB__AFB77651
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaacgagcgugaagcucggcaagaucccgacugucgaaaauuccauauuccacauggccgcguggucaggcagugcaugccaugaugggaaagaguggaccuauaucggaguggacggucccgauaacaaugcccugcuuaagguuaaauacggcgaggcuuacacagacacuuaucacagcuacgccaacaagauucugaggacccaggagucugcauguaauugcaucgggggaaacuguuauuugaugauuacagauggcuccgcuucaggugugagcgaaugccgguuucucaaaauccgcgaggggagaauaauuaaggagaucuucccuaccggaagggucaagcacacggaagaguguacuugcggcuuugccaguaauaaaacaauugaaugugcgugccgggacaacucuuacaccgccaagcgcccauucgugaaacugaauguagagacugauacagcagaaauccgauuaaugugcaccgacacguaucuggauacccccagaccuaacgacggcuccaucacagggccaugugagagcgauggagacaaggguucgggcgggauuaaaggaggcuuuguucaucaaaggauggagucuaagauaggucggugguacucccguacuaugucaaaaaccgaacgcauggggaugggccucuaugugaaguacgacggagaucccugggcugacagugaugcccuugcuuucagcggcgucaugguguccaugaaggagccggggugguacucuuuuggauucgaaaucaaagacaagaaaugcgaugugccuuguauugguaucgagaugguccacgacggcgggaaggaaacauggcauagcgccgcaacugccauauauugccugaugggaucaggccaguugcuaugggauaccguuacagguguggacauggcucuguga

SEQ ID NO: 150970 - RNA, 1401 nt, Artificial Sequence
  derived and/or modified sequence opt3 from neuraminidase__InfluenzaB__AFE00364
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacagauugaggcaccugaucagcgugaaacuaggcaagauaccgacggucgaaaauuccaucuuucauauggcugccuggucaggcagugcgugccacgaugggaaggaguggacuuauauuggaguggacggucccgauaacaaugcacuccugaaaaucaaguacggcgaggccuacaccgacacauaucacagcuacgcuaacaauauucuucggacucaggagucugccuguaacugcaucgggggaaauuguuaucugaugauaaccgauggcuccgcaucagguguuagcgaaugccgcuucuugaaaauuagagaggggaggaucauuaaggagaucuuuccuacaggacgggugaaacauaccgaagaguguacgugcggcuucgcuaguaacaagacuaucgaaugugccugccgcgacaauucuuacacagcgaagcgaccauuugucaaacucaacguggagaccgauacugccgaaauuagacugaugugcacagacaccuauuuagauacgcccaggccugacgauggcuccauaaccgggccaugugagagcaacggagacaaggguucgggcgggaucaaaggaggcuucguacaccagcggauggcaucuaagauuggucguugguacucccgcacaaugucaaaaacugagagaaaggggaugggccuguauguuaaauacgacggagaucccuggaccgacagugaugcucucgccuuuaggggcgugauggucagcaugaaggaaccggggugguacuccuucggauucgagaucaaggacaaaaagugcgaugugccuuguauagguauugaaauggugcaugacggcgggaaagagacauggcacucugcugccacugcaaucuauugccuuaugggaagcggccaacuguugugggauaccgucacagguguugacauggcccuauga

SEQ ID NO: 150971 - RNA, 1401 nt, Artificial Sequence
  derived and/or modified sequence opt3 from neuraminidase__InfluenzaB__AFF18536
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaaugucgacacuucgcucuuacacauuacgcagcccagccaggcgguuauuacaaugggacccguggagacagaaacaaguugaggcaccugaucagcgugaaacuaggcaagauaccgacggucgaaaauuccaucuuucauauggcugccuggucaggcagugcgugccacgaugggaaggaguggacuuauauuggaguggacggucccgauaacaaugcacuccugaaaaucaaguacggcgaggccuacaccgacacauaucacagcuacgcuaacaauauucuucggacucaggagucugccuguaacugcauccgcgggaauuguuaucugaugauaaccgauggauccgcaucaggcguuagcgaaugcagauucuugaaaauuagggagggucggaucauuaaggagaucuuuccuacagggcgcgugaaacauaccgaagaguguacgugcggauucgcuaguaacaagacuaucgaaugugccugccgagacaauucuuacacagcgaagagaccauuugucaaacucaacguggagaccgauacugccgaaauuaggcugaugugcacagacaccuauuuagauacgccccggccugacgauggcuccauaaccggcccaugugagagcaacggggacaagggaucggguggcaucaaagggggauucguacaccagcguauggcaucuaagauuggccgcugguacuccagaacaaugucaaaaacugagaggaaggguauggggcuguauguuaaauacgacggcgaucccuggaccgacagugaugcucucgccuuucggggagugauggucagcaugaaggaaccgggcugguacuccuucggguucgagaucaaggacaaaaagugcgaugugccuuguauaggaauugaaauggugcaugacgguggcaaagagacauggcacucugcugccacugcaaucuauugccuuauggggagcggacaacuguugugggauaccgucacaggcguugacauggcccuauga

SEQ ID NO: 150972 - RNA, 1401 nt, Artificial Sequence
  derived and/or modified sequence opt3 from neuraminidase__InfluenzaB__AFF18545
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcaaagggaugggccuguauguuaaguacgacggagaucccuggaccgacagugaugcucucgccuuuagaggcgugauggucagcaugaaggaaccggggugguacuccuucggauucgagaucaaagacaagaaaugcgaugugccuuguauagguauugaaauggugcaugacggcgggaaggagacauggcacucugcugccacugcaaucuauugccuuaugggaagcggccaacuguugugggauaccgucacagguguugacauggcccuauga

SEQ ID NO: 150973 - RNA, 1401 nt, Artificial Sequence; identical to SEQ ID NO: 150833
  derived and/or modified sequence opt3 from neuraminidase__InfluenzaB__AFH34933

SEQ ID NO: 150974 - RNA, 1401 nt, Artificial Sequence; identical to SEQ ID NO: 150833
  derived and/or modified sequence opt3 from neuraminidase__InfluenzaB__AFH34939

SEQ ID NO: 150975 - RNA, 1401 nt, Artificial Sequence; identical to SEQ ID NO: 150771
  derived and/or modified sequence opt3 from neuraminidase__InfluenzaB__AFH57869

SEQ ID NO: 150976 - RNA, 1401 nt, Artificial Sequence
  derived and/or modified sequence opt3 from neuraminidase__InfluenzaB__AFH57891
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauuaugcaaacgccucgaauguucaggcggugaaccacucagcugccaaaggaguaacucuccugcugccggaacccgaguggaccuacccuagacucagcugcccagguaguacauuccagaaggcauuacugauuucuccccauagguuuggcgaaaccaaaggcaauuccgccccucuuaucauucgggagccauucaucgcuuguggacccacugaaugcaagcacuuugcauugacacauuaugccgcucagccuggcgguuacuauaacgggacccgcgaggaccgaaauaaacugcgucaccuaauaagcgugaagcucggaaagaucccaacggucgagaacuccauuuuccauauggccgcguggucaggcagugcaugucacgauggcaaagaauggacuuacaucgggguggacggaccggauagcaaugcccugcuuaagauuaaauacggugaggcuuauaccgacacauaccacucuuaugccaagaacauccugagaacucaagaauccgcaugcaauuguauaggcggggauugcuacuugaugauuaccgacggacccgcuucaggcaucagcgaguguagguuucucaaaauucgggagggucgcaucaucaaggaaauuuucccuacagggagaguuaagcauaccgaggaaugcacguguggauuugccaguaacaaaacuauagagugcgcguguagggauaauucuuauacagccaagcggccauucgugaaacugaacgucgaaaccgacacugcagagauccgcuuaaugugcacagagaccuaccuggauacgccccgaccuaaugacggcuccauuaccggcccaugcgaaagcgauggggacaagggaucggguggcaucaaagggggauuugugcaccagagaauggcuucuaagauagggaggugguauucccggacaaugucaaaaacuaagcguauggguauggggcucuacguaaaguacgacggcgaucccuggaccgacagugaggcccuugcucugagcggaguuaugguguccauggaggaaccgggcugguauucuuucggguuugaaauuaaagauaagaaaugugacgucccuugcaucggaaucgagauggugcaugaugguggcaagacaacuuggcacagcgccgcaaccgccauuuacuguuugauggggucaggacagcuacugugggacacagugaccggcgucgauauggcucucuga

SEQ ID NO: 150977 - RNA, 1401 nt, Artificial Sequence
  derived and/or modified sequence opt3 from neuraminidase__InfluenzaB__AFH57913
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccugggcagauagugacgcucuugccuucagcggcgucaugguguccaugaaggagccggggugguacucuuuuggauucgaaauuaaagauaagaaaugcgacgugccuuguaucgguauagagaugguccacgauggcgggaaggaaacauggcauagcgcugccacugcaauuuauugccugaugggaucaggccaguugcuaugggacaccguuacagguguggauauggcccuguga

SEQ ID NO: 150978 - RNA, 1401 nt, Artificial Sequence; identical to SEQ ID NO: 150833
  derived and/or modified sequence opt3 from neuraminidase__InfluenzaB__AFH57935

SEQ ID NO: 150979 - RNA, 1401 nt, Artificial Sequence; identical to SEQ ID NO: 150833
  derived and/or modified sequence opt3 from neuraminidase__InfluenzaB__AFH57946

SEQ ID NO: 150980 - RNA, 1401 nt, Artificial Sequence; identical to SEQ ID NO: 150833
  derived and/or modified sequence opt3 from neuraminidase__InfluenzaB__AFH57957

SEQ ID NO: 150981 - RNA, 1401 nt, Artificial Sequence; identical to SEQ ID NO: 150911
  derived and/or modified sequence opt3 from neuraminidase__InfluenzaB__AFH57968

SEQ ID NO: 150982 - RNA, 1401 nt, Artificial Sequence
  derived and/or modified sequence opt3 from neuraminidase__InfluenzaB__AFH57979
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaaucuuccugcugccggaacccgaguggacauauccuaggcucagcuguccagguaguaccuuucagaaggccuuacugauuucuccccaccgguucggcgaaacuaaaggaaauuccgcaccucuuaucauucgcgagccauuuaucgccugcgggcccaacgaauguaagcauuucgcuuugacacacuacgcagcccagccuggcgguuauuacaaugggacccgaggagaccguaacaaacugagacaucuaauaagcgugaagcucggcaagaucccaacggucgaaaauuccauuuuucacauggcugccuggucaggcagugcgugccaugaugggaaagaguggacuuauaucggaguggacgguccggauaacgacgcacugcuuaagguuaaauacggcgaggccuacaccgauacauaucacagcuacgcuaauaagauucugaggacucaggagucugccuguaacugcaucgggggaaauuguuauuugaugauaaccgacggcuccgcaucaggugugagcgaaugccgguuccucaaaauucgcgaggggagaaucauuaaggagaucuuucccacaggaagggucaagcacaccgaagaguguacgugcggcuucgcuaguaacaaaacuaucgaaugugccugccgggauaauucuuacacagcgaagcgcccuuuugugaaacugaacguagagaccgacacugccgaaauucgauuaaugugcacagauaccuaucuggacacgccaagacccgaugacggcuccauaaccgggccuugugagagcaauggagacaaggguucgggcgggaucaaaggaggcuucguucaucaaaggauggagucuaagauuggucggugguacucccguacaaugucaaaaacugaacgcauggggaugggccucuaugugaaguacgauggagacccaugggcagauagugacgcucuugccuuuagcggcgucaugguguccaugaaggagcccgggugguacucuuucggauucgaaaucaaagauaagaaaugcgacgugccguguauagguauugagaugguccacgauggcgggaaggaaaccuggcauagcgcugccacagcaaucuauugccugaugggaucaggccaguugcuaugggacacuguuaccgguguggauauggcccuguga

SEQ ID NO: 150983 - RNA, 1401 nt, Artificial Sequence; identical to SEQ ID NO: 150600
  derived and/or modified sequence opt3 from neuraminidase__InfluenzaB__AFH58253

SEQ ID NO: 150984 - RNA, 1401 nt, Artificial Sequence; identical to SEQ ID NO: 150663
  derived and/or modified sequence opt3 from neuraminidase__InfluenzaB__AFH58264

SEQ ID NO: 150985 - RNA, 1401 nt, Artificial Sequence; identical to SEQ ID NO: 150804
  derived and/or modified sequence opt3 from neuraminidase__InfluenzaB__AFH58275

SEQ ID NO: 150986 - RNA, 1401 nt, Artificial Sequence; identical to SEQ ID NO: 150804
  derived and/or modified sequence opt3 from neuraminidase__InfluenzaB__AFH58286

SEQ ID NO: 150987 - RNA, 1401 nt, Artificial Sequence; identical to SEQ ID NO: 150977
  derived and/or modified sequence opt3 from neuraminidase__InfluenzaB__AFH58297

SEQ ID NO: 150988 - RNA, 1401 nt, Artificial Sequence
  derived and/or modified sequence opt3 from neuraminidase__InfluenzaB__AFH58308
augcugcccagcaccauccagacacucacucuuuuccugacguccggcgggguguuguuaucucuguacgucucagccagucuaagcuaucuccuguacuccgacauucuucugaaguuuucuagaaccgagacaacugcuccuauaaugccauuggauugcgcaaacgccucgaauguucaagcggugaacaggucagcuaccaaaggaguaacacuccugcugccggaacccgaguggaccuauccucggcucagcuguccagguaguacuuuccagaaggccuuacugaucucuccccaccgcuuuggcgaaacaaaaggaaauuccgcaccucuuauuauccgagagccauucauugccugcgggcccaaggaauguaaacauuuugcuuugacccacuacgcagcccagccuggcgguuauuacaacgggacgcgugaggacagaaauaagcugaggcaucuaaucagcgugaagcucggaaaaauaccaacugucgagaacuccaucuuccacauggcugccuggucaggcagugcgugccaugauggccgggaauggaccuauauugggguggacggaccggauagcaaugcacugcuuaagaucaaauacggugaggccuacacagacacuuaucacucuuacgcuaagaacauucugcgcacccaggaauccgccuguaauugcaucggcggggauuguuauuugaugauaacagacggacccgcaucaggcauuagcgagugcagauuucucaaaaucagggagggucggauuaucaaggaaaucuucccuaccgggcgcguuaagcacacggaggaauguacuugcggauuugcuaguaacaaaacaauugagugugccugccgagauaauucuuacaccgcgaagagaccauucgugaaacugaacgucgaaacugacacagccgagauaagguuaaugugcaccgagacguaucuggauacaccccggccuaaugacggcuccaucaccggcccaugugaaagcaacggggauaagggaucggguggcauuaaagggggauuugugcaucaacguauggcaucuaagaucggccgcugguacuccagaacuaugucaaaaaccaagaggauggguauggggcucuauguaaaguacgacggcgaccccuggacagauagugaggcucuugcccugagcggaguuaugguguccauggaggaaccgggcugguacucuuucggguuugaaauaaaagacaagaaaugcgaugucccuuguauuggaaucgagauggugcacgacgguggcaagacuaccuggcauagcgcugccacagcaaucuauugcuugauggggucaggacagcuacugugggauaccgugacuggcgucgacauggcccucuga

SEQ ID NO: 150989 - RNA, 1401 nt, Artificial Sequence; identical to SEQ ID NO: 150988
  derived and/or modified sequence opt3 from neuraminidase__InfluenzaB__AFH58319

SEQ ID NO: 150990 - RNA, 1401 nt, Artificial Sequence
  derived and/or modified sequence opt3 from neuraminidase__InfluenzaB__AFH58341
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugcggcucggaaagaucccaacggucgagaacuccauuuuccacauggcugccuggucaggcagugcgugccaugauggccgcgaauggacuuauaucgggguggacggaccggauagcaaugcacugcuuaaaauuaaguacggugaggccuacaccgacacauaucacucuuacgcuaaaaacauccugagaacucaggaauccgccuguaauugcauaggcggggauuguuauuugaugauuaccgacggacccgcaucaggcaucagcgagugcagguuucucaagauucgggagggucgcaucaucaaagaaauuuucccuacagggcgaguuaagcacaccgaggaauguacgugcggauuugcuaguaacaagacuauagagugugccugcagagauaauucuuacacagcgaaaaggccauucgugaagcugaacgucgaaaccgacacugccgagauccgguuaaugugcacagagaccuaucuggauacgccccguccuaaugacggcuccauuaccggcccaugugaaagcaacggggauaaaggaucggguggcaucaaagggggauuugugcaucaacgcauggcaucuaagauaggcagaugguacuccaggacaaugucaaagacuaaacggauggguauggggcucuauguaaaguacgacggcgaccccuggaccgauagugaggcucuugcccugagcggaguuaugguguccauggaggaaccgggcugguacucuuucggguuugaaauuaaggacaaaaagugcgaugucccuuguaucggaaucgagauggugcacgacgguggcaaaacaacuuggcauagcgcugccaccgcaauuuauugcuugauggggucaggacagcuacugugggauacagugaccggcgucaauaugacucucuga

SEQ ID NO: 150991 - RNA, 1401 nt, Artificial Sequence
  derived and/or modified sequence opt3 from neuraminidase__InfluenzaB__AFH58363
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaaggaauguaaacauuucgcucuuacccacuacgcagcccagccaggcgguuauuacaacgggacgcgaggagaccguaauaaguugagacaucugaucagcgugaagcuaggcaaaauaccgacugucgagaacuccaucuuucacauggcugccuggucaggcagugcgugccaugaugggaaggaguggaccuauauuggaguggacggucccgauaauaacgcacuccugaaaaucaaguacggcgaagccuacacagacacuuaucacagcuacgcuaauaacauucuuaggacccaggagucugccuguaauugcaucgggggaaacuguuaucugaugauaacagauggcuccgcaucagguguuagcgaaugccgguucuugaaaauucgcgaggggagaaucauuaaggagaucuuuccuaccggaaggaucaagcacacggaagaguguacuugcggcuucgcuaguaauaaaacaauugaaugugccugccgggacaacucuuacaccgcgaagcgcccauuugugaaacucaaugucgagacugauacagccgaaauacgacugaugugcaccgagacguauuuagacacccccagaccugaugacggcuccaucacagggccaugugagagcaacggagguaagggcucugggggaauuaaaggcgguuucgugcaucaaaggauggcaucgaagaucgggcggugguacucccguacuaugucaaaaaccgaacgcaagggcaugggacuguauguaaaguacgauggcgaccccugggcugacagugaugcccucgcuuuuagcgggguuaugguguccauggaggaaccgggaugguacucuuucgguuucgagauaaaagacaagaaaugcgaugucccuuguauuggcaucgaaauggugcacgacgggggaaaggagacauggcauagcgccgcaacugccaucuauugccuuaugggcucaggucagcuguugugggauaccgugacaggggucaacauggcucuauga

SEQ ID NO: 150992 - RNA, 1401 nt, Artificial Sequence; identical to SEQ ID NO: 150991
  derived and/or modified sequence opt3 from neuraminidase__InfluenzaB__AFH58374

SEQ ID NO: 150993 - RNA, 1401 nt, Artificial Sequence; identical to SEQ ID NO: 150977
  derived and/or modified sequence opt3 from neuraminidase__InfluenzaB__AFH58385

SEQ ID NO: 150994 - RNA, 1401 nt, Artificial Sequence; identical to SEQ ID NO: 150977
  derived and/or modified sequence opt3 from neuraminidase__InfluenzaB__AFH58396

SEQ ID NO: 150995 - RNA, 1401 nt, Artificial Sequence; identical to SEQ ID NO: 150977
  derived and/or modified sequence opt3 from neuraminidase__InfluenzaB__AFH58407

SEQ ID NO: 150996 - RNA, 1401 nt, Artificial Sequence; identical to SEQ ID NO: 150977
  derived and/or modified sequence opt3 from neuraminidase__InfluenzaB__AFH58418

SEQ ID NO: 150997 - RNA, 1401 nt, Artificial Sequence
  derived and/or modified sequence opt3 from neuraminidase__InfluenzaB__AFH58429
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaaugaaacaaucgagugugccugccgggacaacucuuacaccgcgaaacgcccauucgugaagcugaauguagaaacugauacagccgagauccgauuaaugugcaccgacacguaucuggauacccccagaccuaacgacggcuccauuacagggccaugugagagcaacggagauaaagguucgggcgggauaaagggaggcuuuguucaucaaaggauggaaucuaaaaucggucggugguacucccguacuaugucaaagaccgagcgcauggggaugggccucuaugugaaauacgacggagaccccugggcagauagugacgcucuugccuucagcggcgucaugguguccaugaaggaaccggggugguacucuuuuggauucgagauuaaggauaaaaagugcgacgugccuuguaucgguauagaaaugguccacgauggcgggaaagagacauggcauagcgcugccacugcaauuuauugccugaugggaucaggccaguugcuaugggacaccguuacagguguggauauggcccuguga

SEQ ID NO: 150998 - RNA, 1401 nt, Artificial Sequence
  derived and/or modified sequence opt3 from neuraminidase__InfluenzaB__AFH58440
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacaagaggggcgcauuaucaaggagauuuucccuaccggaagagucaagcacacggaagaguguacuugcggcuuugcuaguaauaaaacaaucgaaugugccugcagggacaacucuuacaccgcgaagcggccauucgugaaacugaauguagagacugauacagccgaaauccgcuuaaugugcaccgacacguaucuggauacaccccgaccuaacgacggcuccauuaccgggccaugugagagcaacggagauaaggguucgggcgggauaaaaggaggcuuuguucaucagagaauggagucuaagaucgguaggugguacucccggacuaugucaaaaaccgaacguauggggaugggccucuaugugaaguacgacggagaccccugggcagauagugacgcucuugccuucagcggcgucaugguguccaugaaggagccggggugguacucuuuuggauucgaaauuaaagauaagaaaugcgacgugccuuguaucgguauagagaugguccacgauggcgggaaggaaacauggcauagcgcugccacugcaauuuauugccugaugggaucaggccaguugcuaugggacaccguuacagguguggauauggcccuguga

SEQ ID NO: 150999 - RNA, 1401 nt, Artificial Sequence
  derived and/or modified sequence opt3 from neuraminidase__InfluenzaB__AFH58462
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaacgaauguaagcauuucgcucuuacccacuacgcagcccagccaggcgguuauuacaaugggacgcgaggagaccguaacaaauugagacaucugaucagcgugaagcuaggcaagauaccgacugucgaaaauuccaucuuucacauggcugccuggucaggcagugcgugccaugaugggaaagaguggaccuauauuggaguggacggucccgauaacaaugcacuccugaagguuaaauacggcgaggccuacacagacacuuaucacagcuacgcuaacaagauccuuaggacccaggagucugccuguaauugcauugggggaaacuguuaucugaugaucacagauggcuccgcaucaggugugagcgaaugccgguucuugaaaauacgcgaggggagaauuaucaaggagauuuuuccuaccggaagggucaagcacacggaagaguguacuugcggcuucgcuaguaauaaaacaaucgaaugugccugccgggacaacucuuacaccgcgaagcgcccauuugugaaacucaauguagagacugauacagccgaaauccgacugaugugcaccgacacguauuuagauacccccagaccugacgauggcuccauuacagggccaugugagagcaacggagacgaggguucgggcgggauaaagggaggcuucguucaucaaaggauggaaucuaaaaucggucggugguacucccguacuaugucaaagaccgagcgcauggggaugggccuguaugugaaauacgacggagaucccugggcagacagugaugcucucgccuuuagcggcgucaugguguccaugaaggaaccggggugguacucuuucggauucgagauuaaggacaaaaagugcgaugugccuuguaucgguauagaaaugguccacgacggcgggaaagagacauggcauagcgcugccacugcaauuuauugccuuaugggaucaggccagcuguugugggauaccguuacagguguggacaugacccuauga

SEQ ID NO: 151000 - RNA, 1401 nt, Artificial Sequence; identical to SEQ ID NO: 150999
  derived and/or modified sequence opt3 from neuraminidase__InfluenzaB__AFH58473

SEQ ID NO: 151001 - RNA, 1401 nt, Artificial Sequence; identical to SEQ ID NO: 150833
  derived and/or modified sequence opt3 from neuraminidase__InfluenzaB__AFH58484

SEQ ID NO: 151002 - RNA, 1401 nt, Artificial Sequence; identical to SEQ ID NO: 150833
  derived and/or modified sequence opt3 from neuraminidase__InfluenzaB__AFH58495

SEQ ID NO: 151003 - RNA, 1401 nt, Artificial Sequence; identical to SEQ ID NO: 150833
  derived and/or modified sequence opt3 from neuraminidase__InfluenzaB__AFH58506

SEQ ID NO: 151004 - RNA, 1401 nt, Artificial Sequence
  derived and/or modified sequence opt3 from neuraminidase__InfluenzaB__AFH58517
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguauagagaugguccacgauggcgggaaggaaacauggcauagcgcugccacugcaauuuauugccugaugggaucaggcagauugcuaugggacaccguuacagguguggauauggcccuguga

SEQ ID NO: 151005 - RNA, 1401 nt, Artificial Sequence; identical to SEQ ID NO: 150911
  derived and/or modified sequence opt3 from neuraminidase__InfluenzaB__AFH58528

SEQ ID NO: 151006 - RNA, 1401 nt, Artificial Sequence
  derived and/or modified sequence opt3 from neuraminidase__InfluenzaB__AFH58539
augcugcccagcaccgugcagacacucacucuucuguugacguccggcggggucuuacugucucuauacguuucagccagucucagcuaucugcuuuacuccgacgugcuguugaaguucucuucgaccaaaacaacugcuccuaccaugucacucgagugcacaaacgcaagcaaugcccaaaccguaaaccacagugcgacuaaggaaaugacauuuccaccgcccgagccugaauggaccuauccaagacuguccugucagggaucuacguuccagaaagcucugcucaucagcccccauagguuuggugagauuaagggcaauuccgccccuuuaauaauccgggaaccauucguggcaugcgggcccaaagagugucgccacuuugcccugacucauuacgcugcacagccuggaggcuauuacaacgguacccgaaaggaucguaauaaacuuagacacuuggucucagugaagcuggggaagauuccaacaguugagaacaguaucuuccauauggccgcuuggagcggaucugccugccacgacggcagggaauggacuuauauuggcguggaugggccggacaaugaugcgcuagucaaaaucaaguacggagaggcauacaccgacacauaucacuccuacgcccauaacauacuccggacccaagaaucagcuuguaauugcaucgguggcgauuguuaucugaugauuacggacgggagcgccaguggaaucucuaaaugccgcuuucuuaagauuagagagggcaggaucauaaaggagauucugcccacuggucggguggaacacacagaggaauguaccugcggguucgcauccaacaaaacuaucgagugugcuugccgcgauaauagcuacacagccaagcgaccuuuuguaaaauugaacguugaaaccgacacggcggagauuagacucaugugcaccaagacauaucuggauacuccaaggcccgacgauggaucgaucgccggcccuugugagucuaauggcgacaaaugguuagggggaaucaaggguggcuucgugcaucagcggauggcauccaaaauugggcguugguacucacgcaccaugaguaagacaaacagaaugggaauggaacuguaugucaaguacgacggcgauccauggacugacagcgaugcucucacccuuuccggugugauggugucuauagaggaacccgggugguacagcuuuggcuucgagaucaaagacaagaaaugcgaugucccguguauuggaaucgaaaugguucacgacggcgggaaggauacauggcacucagccgcuaccgccauauauugccugaugggaaguggucaguugcuaugggacacugcaacgggcguggauauggcccuguga

SEQ ID NO: 151007 - RNA, 1401 nt, Artificial Sequence
  derived and/or modified sequence opt3 from neuraminidase__InfluenzaB__AFH58550
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaagaaaugacacuccugcugcccgagccugaauggaccuauccaaggcucagcugucccggaaguacuuuccagaaggccuuacugaucuccccucaccgguuuggugagacacgcggcaauucugcaccacuuaccauucgagaacccuucaucgccugcgggccuaaagaguguaagcauuuugcuuugacgcacuacgcagcccagccaggaggcuauuacaacgguacucgugaggacagaaauaaacugaggcaucuaauuagcguaaagcucgggaagaucccgaccguggaaaacuccauauuccacauggcugccuggucaggaagugcgugccaugauggccgggaguggacauauaucggcgucgacgggcccgauagcaaugcacugauuaaaaucaaguacggagaagccuacacugacaccuaucacucuuacgcuaacaauauucuucgcacacaggaguccgccuguaacugcaucgguggcgauuguuaucugaugauaaccgacgggucagcaagcggaauuaguaaaugcagauuuuugaagaucagggagggccggauuaucaaagaaaucuucccuacgggucgcguggagcacacugaagaguguacaugcggguuugcuucuaauaagaccauugaaugugccugccgagauaacuccuacacugcgaagagaccauucguuaaacucaauguggagacagacaccgccgagauaaggcugaugugcacggaaaccuauuuagauacaccccggccugacgauggaagcaucacuggcccaugugagucgaacggcgacaaggggcguggagguauuaaaggcggguuuguccaucaacgcauggcaucuaagaucggaagaugguacuccaggaccaugucaaaaacagaacggaugggcauggagcuguaugugaaguacgacggugaucccuggacugacagugaagcucucgccccgagcgggguaaugguuuccauggaggagccuggcugguacucuuucggauuugaaauaaaagauaagaagugcgacgugcccuguauuggcaucgagaugguccacgauggggguaaaaagaccuggcauagcgcugccacagcaaucuauugccuuaugggaucaggccagcuguugugggacaccgugacugggguggauauggcccuauga

SEQ ID NO: 151008 - RNA, 1401 nt, Artificial Sequence; identical to SEQ ID NO: 151007
  derived and/or modified sequence opt3 from neuraminidase__InfluenzaB__AFH58561

SEQ ID NO: 151009 - RNA, 1401 nt, Artificial Sequence
  derived and/or modified sequence opt3 from neuraminidase__InfluenzaB__AFJ69969
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccuggacagauagugacgcacuugcuuucagcggcgucaugguguccaugaaggagccggggugguacucuuuuggauucgaaauuaaagauaagaaaugcgacgugccuuguaucgguauagagaugguccacgauggcgggaaggaaacuuggcauagcgccgcuaccgccauuuauugccugaugggaucaggccaguugcuaugggacacaguuaccgguguggauauggcacuguga

SEQ ID NO: 151010 - RNA, 1401 nt, Artificial Sequence; identical to SEQ ID NO: 150972
  derived and/or modified sequence opt3 from neuraminidase__InfluenzaB__AFJ69971

SEQ ID NO: 151011 - RNA, 1401 nt, Artificial Sequence
  derived and/or modified sequence opt3 from neuraminidase__InfluenzaB__AFJ69973
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgcuugccgguucuugaagauucgcgaagggagaaucauuaaagagaucuuuccuacaggaagggugaagcauaccgaggaauguacgugcggcuucgccaguaacaagacuaucgagugugcgugccgggacaauucuuacacagccaaacgcccauuugucaagcucaacguggaaaccgauacugcagagauucgacugaugugcacagacaccuauuuagauacgcccagaccugacgauggcuccauaaccgggccaugugaaagcaacggagacaaagguucgggcgggaucaagggaggcuucguacaccagaggauggcuucuaaaauuggucggugguacucccguacaaugucaaagacugagcgcaaagggaugggccuguauguuaaguacgacggagaucccuggaccgacagugaugcccucgcuuuuagaggcgugauggucagcaugaaggagccggggugguacuccuucggauucgaaaucaaagacaagaaaugcgaugugccuuguauagguauugagauggugcaugacggcgggaaggaaacauggcacucugccgcaacugccaucuauugccuuaugggaagcggccaacuguugugggauaccgucacagguguugacauggcucuauga

SEQ ID NO: 151012 - RNA, 1401 nt, Artificial Sequence; identical to SEQ ID NO: 150833
  derived and/or modified sequence opt3 from neuraminidase__InfluenzaB__AFJ69975

SEQ ID NO: 151013 - RNA, 1401 nt, Artificial Sequence
  derived and/or modified sequence opt3 from neuraminidase__InfluenzaB__AFJ69979
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacaccucgaauguucaagccgugaaccacucagcgacaaaaggaguaacccuccugcugcccgaaccugaguggacuuauccaagacucagcugucccgguaguacauuccagaaggcuuuacugaucuccccucauagguuuggcgaaaccaaaggaaauucugccccacuuauuauccgggagcccuucauugcaugcgggccuaacgaauguaagcacuuugccuugacgcauuacgcugcacagccaggcgguuauuacaaugggacucgcggagaccgaaacaaacugcgucaccuaaucagcgugaagcucggcaagauaccgaccgucgaaaauuccaucuuccauauggccgcuuggucaggcagugccugccacgaugggaaagaguggacauauauuggaguggacggucccgauaacaaugcgcugcuuaagguuaaauacggcgaggcauacacugacaccuaucacagcuacgccaacaagauccugagaacacaggagucugcuuguaauugcauugggggaaacuguuauuugaugaucaccgauggcuccgccucaggugugagcgaaugcagguuucucaaaauacgggaggggcgcauuaucaaggagauuuucccuacgggaagagucaagcauacugaagaguguacaugcggcuuugcaaguaauaaaaccaucgaaugugcuugcagggacaacucuuacacugccaagcggccauucgugaaacugaauguagagacagauaccgcggaaauccgcuuaaugugcacggacaccuaucuggauacaccccgaccugacgauggcuccauuacugggccaugugagagcaacggagacaaggguucgggcgggauaaaaggaggcuuuguucaccaaagaauggagucuaagaucgguaggugguacucccggaccaugucaaaaacagaacguauggggaugggccucuaugugaaguacgacggagaucccugggccgacagugaugcacuugcuuucagcggcgucaugguguccaugaaggagccggggugguacucuuuuggauucgaaauuaaagacaagaaaugcgaugugccuuguaucgguauagagaugguccaugacggcgggaaggaaacuuggcacagcgccgcuaccgccauuuauugccugaugggaucaggccaguugcuaugggauacaguuaccgguguggacauggcacuguga

SEQ ID NO: 151014 - RNA, 1401 nt, Artificial Sequence; identical to SEQ ID NO: 150972
  derived and/or modified sequence opt3 from neuraminidase__InfluenzaB__AFJ69981

SEQ ID NO: 151015 - RNA, 1401 nt, Artificial Sequence
  derived and/or modified sequence opt3 from neuraminidase__InfluenzaB__AFJ69983
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagauccucccuacaggaagggugaagcauaccgaagaguguacgugcggcuuugcuaguaacaagacuaucgaaugugccugccgggacaauucuuacacagcgaaacgcccauucgucaagcugaacguggagaccgauacugccgaaauucgauuaaugugcacagacaccuaucuggauacgcccagaccugacgauggcuccauaaccgggccaugugagagcaacggagguaaaggcucugggggaaucaagggcgguuuuguacaccagaggauggcaucgaaaauugggcggugguacucccguacaaugucaaagacugagcgcaaaggcaugggacucuauguuaaguacgacggcgaccccuggaccgauagugacgcucuugccuucagaggggugauggucagcaugaaggaaccgggaugguacuccuuugguuucgagaucaaagauaagaaaugcgacgugccuuguauaggcauugaaauggugcaugaugggggaaaggagacauggcacucugcugccacugcaaucuauugccugaugggcagcggucaauugcuaugggacaccgucacagggguugauauggcccuguga

SEQ ID NO: 151016 - RNA, 1401 nt, Artificial Sequence
  derived and/or modified sequence opt3 from neuraminidase__InfluenzaB__AFJ69987
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggacuaaaggaggcuuuguucaucaacggaugaagucgaaaauaggucguugguacucucgcaccauguccaagacagagagaauggggaugggccucuaugugaaguacgacggagaucccugggcagacucagaugcucuuacuuucaguggcgucauggugagcaugaaagaaccggggugguacuccuuuggauucgagaucaaggacaaaaagugcgaugugccuuguauugguaucgaaaugguccacgacggcgggaaagagaccuggcauucugccgcuacagccauauauugccugaugggaagcggccaguugcuaugggauaccguuacugguguggacauggcacuguga

SEQ ID NO: 151017 - RNA, 1401 nt, Artificial Sequence
  derived and/or modified sequence opt3 from neuraminidase__InfluenzaB__AFJ76228
augcugcccagcaccauccagacacucacucuuuuccugacguccggcgggguguuguuaucucuguacgucucagccagucuaagcuaucuccuguacuccgguauucuucugaaguuuucuccuaccgagauaacagcuccaacuaugccguugaacugcgcaaaugccucgaacguucaagcggugaauagaucagcuaccaaaggaguaacacuccugcugcccgaaccugaguggaccuauccaaggcucagcugucccggcaguacuuuccagaaggccuuacugaucuccccucaccgguuuggggaaacaaaaggaaacucugcaccacuuauuauccgcgagcccuucauugccugcggcccuaaggaauguaaacauuuugcuuugacccacuacgcagcccagccagguggguauuacaauggaacgcgagaggaccguaacaagcugagacaucuaaucagcgugaagcucggcaaaauaccgacugucgaaaauuccaucuuccacauggcugccuggucaggcagugcgugccaugaugggagggaauggaccuauauuggaguggacggucccgauagcaacgcacugcuuaagaucaaauacggcgaggccuacacagacacuuaucacucuuacgcuaauaacauucugcggacccaggaauccgccuguaauugcaucgggggagauuguuauuugaugauaacagacggcucagcaagcgguauuagugagugccgcuuucucaagaucagagaggggaggauuaucaaagaaaucuucccuaccggacggguugagcacacggaagaguguacuugcggcuuugcuucuaacaagacaauugaaugugccugccgcgauaauuccuacaccgcgaagcgaccauucgugaaacugaacgucgagacugacacagccgagauaagauuaaugugcaccgaaacguaucuggauacccccaggccugacgauggcagcaucacagggccaugugagucgaauggagacaaggguucuggcgggauuaaaggaggcuuugugcaucaacggauggcauccaagaucggucguugguacucacgcacuaugaguaaaaccaagagaauggggaugggccucuauguaaaauacgauggagaccccuggauagacagcgaugcucuuacacuguccggcguuauggugucuauggaggagccggggugguacagcuucggauuugaaauuaaggacaagaaaugcgaugucccuuguaucgguaucgagauggugcacgacggcgggaagaaaacuuggcauucagccgcuaccgccauuuauugcuugaugggaaguggccagcuacugugggauacagugaccggugucgacauggcacucuga

SEQ ID NO: 151018 - RNA, 1401 nt, Artificial Sequence; identical to SEQ ID NO: 150684
  derived and/or modified sequence opt3 from neuraminidase__InfluenzaB__AFJ76261

SEQ ID NO: 151019 - RNA, 1401 nt, Artificial Sequence
  derived and/or modified sequence opt3 from neuraminidase__InfluenzaB__AFJ76283
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaagcucggcaaaauacccacugucgagaacagcaucuuccacauggcugccugguccggcucagcgugccaugaugggaaggaguggaccuauauuggaguggacgguccugauaauaacgcacugcuuaaaaucaaguacggcgaagccuacacagacacuuaucacaguuacgcuaauaacauucugaggacccaggagagcgccuguaauugcaucgggggaaacuguuauuugaugauaacagauggcucugcauccgguguuucagaaugccgguuucucaaaauucgcgaggggagaaucauuaaggagaucuucccaaccggaaggaucaagcacacggaagaguguacuugcggcuuugcuagcaauaaaacaauugaaugugccugccgggacaacaguuacaccgcgaagcgccccuucgugaaacugaaugucgagacugauacagccgaaauacgauuaaugugcaccgagacguaucuggacaccccuagaccagaugacggcucuaucacagggcccugugaguccaacggagauaaggguagcggcgggauuaaaggaggcuuugugcaucaaaggauggcaucgaagaucggucggugguacucucguacuauguccaaaaccgaacgcauggggaugggccucuauguaaaguacgacggagacccgugggcugauucagacgcccuuacauucaguggcguuauggugagcauggaggaaccugggugguacuccuuuggauucgagauaaaggauaaaaagugcgacguccccuguauugguaucgaaauggugcacgauggcgggaaagagacuuggcauucugcugccaccgcaaucuauugccugaugggaagcggccaguugcuaugggacacagugaccggugucaacauggcccuguga

SEQ ID NO: 151020 - RNA, 1401 nt, Artificial Sequence
  derived and/or modified sequence opt3 from neuraminidase__InfluenzaB__AFJ76305
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagcgggccuuacugaucuccccucaccgcuuuggcgaaacaaagggaaauucugcaccacuuauuauccgagagcccuucauugccugcgggccuaaagaauguaagcauuuugcuuugacccacuacgcagcccagccaggcgguuauuacaacgggacgcguggagacagaaauaaacugaggcaucuaaucagcgugaagcucggcaagauaccgacugucgagaacuccaucuuccacauggcugccuggucaggcagugcgugccaugaugggaaagaguggaccuauauuggaguggacggucccgauaauaacgcacugcuuaagaucaaauacggcgaagccuacacagacacuuaucacagcuacgcuaauaacauucugcggacccaggagucugccuguaauugcaucgggggaaacuguuauuugaugauaacagauggcuccgcaucagguguuagcgaaugccgcuuucucaagauuagagaggggaggaucauuaaagagaucuucccuaccggacggaucaagcacacggaagaguguacuugcggcuuugcuaguaauaagacaauugaaugugccugccgcgacaacucuuacaccgcgaaacgaccauucgugaagcugaaugucgagacugauacagccgaaauaagauuaaugugcaccgagacguaucuggacacccccaggccugaugacggcuccaucacagggccaugugagagcaacggagauaaagguucgggcgggauuaagggaggcuuugugcaucaacggauggcaucuaaaaucggucguugguacucccgcacuaugucaaagaccgaaagaauggggaugggccucuauguaaaauacgacggagaccccugggcugauagugacgcccuuacauucagcggcguuaugguguccauggaggaaccggggugguacucuuuuggauucgagauaaaggauaagaaaugcgacgucccuuguauugguaucgaaauggugcacgauggcgggaaggagacuuggcauagcgcugccaccgcaaucuauugccugaugggaucaggccaguugcuaugggacacagugaccggugucgauauggcccuguga

SEQ ID NO: 151021 - RNA, 1401 nt, Artificial Sequence
  derived and/or modified sequence opt3 from neuraminidase__InfluenzaB__AFJ76316
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccgaacgcauggggaugggccucuauguaaaguacgacggagaccccugggcugauagugacgcccuuacauucagcggcguuaugguguccauggaggaaccggggugguacucuuuuggauucgagauaaaggauaaaaagugcgacgucccuuguauugguaucgaaauggugcacgauggcgggaaagagacuuggcauagcgcugccaccgcaaucuauugccugaugggaucaggccaguugcuaugggacacagugaccggugucaacauggcccuguga

SEQ ID NO: 151022 - RNA, 1401 nt, Artificial Sequence; identical to SEQ ID NO: 150684
  derived and/or modified sequence opt3 from neuraminidase__InfluenzaB__AFJ76338

SEQ ID NO: 151023 - RNA, 1401 nt, Artificial Sequence
  derived and/or modified sequence opt3 from neuraminidase__InfluenzaB__AFJ77331
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcugccaaaggaguaacucuccugcugccggaacccgaguggaccuauccuagacucagcuguccagguaguacauuccagaaggcauuacugauuucuccccauagguuuggcgaaaccaaaggcaauuccgccccucuuaucauucgggagccauucaucgcuugcggacccacugaauguaagcacuuugcauugacacauuacgccgcucagccuggcgguuauuacaacgggacccgcgaggaccgaaauaaacugcgucaccuaauaagcgugaagcucggaaagaucccaacggucgagaacuccauuuuccauauggccgcguggucaggcagugcaugccacgauggcaaagaauggacuuauaucgggguggacggaccggauagcaaugcccugcuuaagauuaaauacggugaggcuuacaccgacacauaucacucuuacgccaagaacauccugagaacucaagaauccgcauauaauuguauaggcggggauugcuacuugaugauuaccgacggacccgcuucaggcaucagcgaguguagguuucucaaaauucgggagggucgcaucaucaaggaaauuuucccuacagggagaguuaagcauaccgaggaaugcacguguggauuugccaguaacaaaacuauagagugcgcguguagggauaauucuuauacagccaagcggccauucgugaaacugaacgucgaaaccgacacugcagagauccgcuuaaugugcacagagaccuaccuggauacgccccgaccuaaugacggcuccauuaccggcccaugcgaaagcgauggggacaagggaucggguggcaucaaagggggauuugugcaccagagaauggcuucuaagauagggaggugguauucccggacaaugucaaaaacuaagcguauggguauggggcucuacguaaaguacgacggcgaucccuggaccgacagugaggcccuugcucugagcggaguuaugguguccauggaggaaccgggcugguauucuuucggguuugaaauuaaagauaagaaaugugacgucccuugcaucggaaucgagauggugcaugaugguggcaagacaacuuggcacagcgccgcaaccgccauuuacuguuugauggggucaggacagcuacugugggacacagugaccggcgucgauauggcucucuga

SEQ ID NO: 151024 - RNA, 1401 nt, Artificial Sequence; identical to SEQ ID NO: 150759
  derived and/or modified sequence opt3 from neuraminidase__InfluenzaB__AFJ77351

SEQ ID NO: 151025 - RNA, 1401 nt, Artificial Sequence; identical to SEQ ID NO: 150651
  derived and/or modified sequence opt3 from neuraminidase__InfluenzaB__AFJ77362

SEQ ID NO: 151026 - RNA, 1401 nt, Artificial Sequence; identical to SEQ ID NO: 150804
  derived and/or modified sequence opt3 from neuraminidase__InfluenzaB__AFJ77384

SEQ ID NO: 151027 - RNA, 1401 nt, Artificial Sequence; identical to SEQ ID NO: 150726
  derived and/or modified sequence opt3 from neuraminidase__InfluenzaB__AFJ80132

SEQ ID NO: 151028 - RNA, 1401 nt, Artificial Sequence
  derived and/or modified sequence opt3 from neuraminidase__InfluenzaB__AFJ80143
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcagggaauggaccuauauugggguggacggacccgauagcaaugcacugcuuaagaucaaauacggugaggccuacacagacacuuaucacucuuacgcuaacaauauucugcggacccaggaauccgccuguaacugcaucggcgggaauuguuauuugaugauaacagauggaucagcaagcggcauuagugagugccgcuuucucaagaucagagaggguaggauuaucaaagaaaucuucccuaccgggcggguugagcacacggaagaguguacuugcggauuugcuucuaacaagacaauugaaugugccugccgcgacaauuccuacaccgcgaagcgaccauucgugaaacugaacgucgagacugauacagccgagauaagauuaaugugcaccgaaacguaucuggacacccccaggccugaugacggcagcaucacaggcccaugugagucgaauggggauaagggaucugguggcauuaaagggggauuugugcaucaacggauggcauccaagaucggccguugguacucacgcacuaugaguaaaaccaagagaauggguauggggcucuauguaaaauacgacggcgaccccuggacagauagcgacgcucuugcccuguccggaguuauggugucuauggaggaaccgggcugguacagcuucggguuugaaauaaaggauaagaaaugcgacgucccuuguauuggaaucgagauggugcacgaugguggcaagaaaacuuggcauucagcugccaccgcaaucuauugcuugauggggaguggacagcuacugugggacacagugaccggcgucgauauggcccucuga

SEQ ID NO: 151029 - RNA, 1401 nt, Artificial Sequence
  derived and/or modified sequence opt3 from neuraminidase__InfluenzaB__AFJ80154
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccaucuuaauuuccccucaccgguuuggcgaaacaaaaggaaauucugcaccacugaucauucgcgagcccuucaucgccugcgggccuaaggaauguaaacauuuugcucuuacccacuacgcagcccagccaggcgguuauuacaacgggacgcgagaggaccguaauaaguugagacaucugauaagcgugaagcuaggaaaaaucccgacugucgagaacuccauuuuccacauggcugccuggucaggcagugcgugccaugauggcagggaauggaccuauaucgggguggacggacccgauagcaaugcacuccugaagauuaaauacggugaggccuacacagacacuuaucacucuuacgcuaacaauauccuucggacccaggaauccgccuguaacugcauaggcgggaauuguuaucugaugauuacagauggaucagcaagcggcaucagugagugccgcuuuuugaagauuagagaggguaggaucaucaaagaaauuuucccuaccgggcggguugagcacacggaagaguguacuugcggauuugcuucuaacaagacaauagaaugugccugccgcgacaauuccuacaccgcgaagcgaccauucgugaaacucaacgucgagacugauacagccgagaucagacugaugugcaccgaaacguauuuagacacccccaggccugaugacggcagcauuacaggcccaugugagucgaauggggauaagggaucugguggcaucaaagggggauuugugcaucaacggauggcauccaagauaggccguugguacucacgcacuaugaguaaaaccaagagaauggguauggggcuguauguaaaauacgacggcgaccccuggacagauagcgacgcucucgcccuuuccggaguuauggugucuauggaggaaccgggcugguacagcuucggguuugaaauuaaggauaagaaaugcgacgucccuuguaucggaaucgagauggugcacgaugguggcaagaaaacuuggcauucagcugccaccgcaauuuauugccugauggggaguggacaguugcuaugggacacagugaccggcgucgauauggcccuguga

SEQ ID NO: 151030 - RNA, 1401 nt, Artificial Sequence
  derived and/or modified sequence opt3 from neuraminidase__InfluenzaB__AFJ80165
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaucccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugauuuccccucaccgguuuggcgaaaucaaaggaaauucugcaccacuuauuauccgcgagcccuucauagccugcgggccuaaggaauguaaacauuuugcuuugacacacuacgcagcccagccaggcgguuauuacaacgggacccgagaggaccguaauaagcugagacaucuaaucagcgugaagcucggaaaaauuccgacggucgagaacuccaucuuccacauggcugccuggucaggcagugcgugccaugauggcaaggaauggacuuauauugggguggacggacccgauagcaaugcacugcuuaaaaucaaguacggugaggccuacaccgacacauaucacucuuacgcuaacaauauacugaggacucaggaauccgccuguaacugcauuggcgggaauuguuauuugaugaucaccgauggaucagcaagcggcauuagugagugccgguuucucaaaauccgcgaggguagaaucauuaaggaaauauucccuacagggaggguugagcacaccgaagaguguacgugcggauuugcuucuaacaagacuaucgaaugugccugccgggacaauuccuacacagcgaaacgcccauucgugaagcugaacgucgagaccgauacugccgagauucgauuaaugugcacagaaaccuaucuggacacgcccagaccugaugacggcagcaucaccggcccaugugagucgaauggggauaaaggaucugguggcauaaaagggggauuugugcaucaaaggauggcauccaagauuggccggugguacucacguacaaugaguaagacuaaacgcauggguauggggcucuauguaaaguacgacggcgaccccuggaccgauagcgacgcucuugcccuguccggaguuauggugucuauggaggaaccgggcugguacagcuucggguuugaaaucaaggauaaaaagugcgacaucccuuguauuggaaucgagaugguccacgaugguggcaaagagacauggcauucagcugccacugcaauuuauugcuugauggggaguggacagcuacugugggacaccgugacaggcguggauauggcccucuga

SEQ ID NO: 151031 - RNA, 1401 nt, Artificial Sequence
  derived and/or modified sequence opt3 from neuraminidase__InfluenzaB__AFJ80176
augcugcccagcaccauccagacacucacucuuuuccugacguccggcgggguguuguuaucucuguacgucucagccagucuaagcuaucuccuguacuccgacauucuucugaaguuuucuccuaccgagauaacaguuccaacuaugccguuggauugcgcuaacgcaucgaaugugcaagccguaaacagaucagcgaccaaaggagugacacuccugcugcccgaaccugaguggaccuauccaaggcucagcugucccgguaguacuuuccagaaggcuuuacugaucuccccucaccgguuuggcgaaacaaaaggaaauucugccccacuuauuauccgcgagcccuucauugcaugcgggccuaaggaauguaaacauuuugccuugacccacuacgcugcacagccaggcgguuauuacaacgggacgcgagaggaccguaauaagcugagacaucuaaucagcgucaagcucggaaaaauaccgacuguggagaacuccaucuuccacauggccgcuuggucaggcagugccugccaugauggcagggaauggaccuauauugggguugacggacccgauagcaaugcgcugcuuaagaucaaauacggugaggcauacacagacacuuaucacucuuacgccaacaauauucugcggacccaggaauccgcuuguaacugcaucggcgggaauuguuauuugaugauaacagauggaucagccagcggcauuagugagugccgcuuucucaagaucagagaggguaggauuaucaaagaaaucuucccuaccgggcggguggagcacacggaagaguguacuugcggauuugcaucuaacaagacaauugaaugugcuugccgcgacaauuccuacaccgccaagcgaccauucgucaaacugaacguggagacugauacagcggagauaagauuaaugugcaccgaaacguaucuggacacccccaggccugaugacggcagcaucacaggcccaugugagucgaauggggauaagggaucugguggcauuaaagggggauuuguacaucaacggauggccuccaagaucggccguugguacucacgcacuaugaguaaaaccaagagaauggguauggggcucuauguuaaauacgacggcgaccccuggacagauagcgacgcacuugcucuguccggagugauggucucuauggaggaaccgggcugguacagcuucggguuugaaauaaaggauaagaaaugcgacgugccuuguauuggaaucgagauggugcacgaugguggcaagaaaacuuggcauucagccgcuaccgccaucuauugcuugauggggaguggacagcuacugugggacacagucaccggcguugauauggcacucuga

SEQ ID NO: 151032 - RNA, 1401 nt, Artificial Sequence
  derived and/or modified sequence opt3 from neuraminidase__InfluenzaB__AFJ80187
augcugcccagcaccauccagacacucacucuuuuccugacguccggcgggguguuguuaucucuguacgucucagccagucuaagcuaucuccuguacuccgguauucuucugaaguuuucuccuaccgagauaacagcuccaacuaugccguugaacugcgcaaaugccucgaacuuccaagcgguuaauagaucagcuaccaaaggagugacacuccugcugcccgaaccugaguggaccuauccaaggcucagcugucccggcaguacuuuucagaaggccuuacugaucuccccucaccgguucggggaaacaaaaggaaacucugcaccacuuauuauccgcgagcccuuuauugccugcggcccuaaggaauguaaacauuucgcuuugacccacuacgcagcccagccagguggguauuacaauggaacgcgagaggaccguaacaagcugagacaucuaaucagcguaaagcucggcaaaauaccgacuguggaaaauuccaucuuucacauggcugccuggucaggcagugcgugccaugaugggagggaauggaccuauauuggagucgacggucccgauagcaacgcacugcuuaagaucaaauacggcgaggccuacacagacacuuaucacucuuacgcuaauaacauucugcggacccaggaauccgccuguaauugcaucgggggagauuguuauuugaugauaacagacggcucagcaagcgguauuagugagugccgcuuccucaagaucagagaggggaggauuaucaaagaaaucuuuccuaccggacggguggagcacacggaagaguguacuugcggcuucgcuucuaacaagacaauugaaugugccugccgcgauaauuccuacaccgcgaagcgaccauuuguuaaacugaacguggagacugacacagccgagauaagauuaaugugcaccgaaacguaucuggauacccccaggccugacgauggcagcaucacagggccaugugagucgaauggagacaaggguucuggcgggauuaaaggaggcuucguccaucaacggauggcauccaagaucggucguugguacucacgcacuaugaguaaaaccaagagaauggggaugggccucuaugugaaauacgauggagaccccuggauagacagcgaugcucuuacacuguccggcguaaugguuucuauggaggagccggggugguacagcuuuggauucgaaauuaaggacaagaaaugcgaugugccuuguaucgguaucgagaugguccacgacggcgggaagaaaacuuggcauucagccgcuaccgccauuuauugcuugaugggaaguggccagcuacugugggauacagugaccgguguggacauggcacucuga

SEQ ID NO: 151033 - RNA, 1401 nt, Artificial Sequence; identical to SEQ ID NO: 151028
  derived and/or modified sequence opt3 from neuraminidase__InfluenzaB__AFJ80198

SEQ ID NO: 151034 - RNA, 1401 nt, Artificial Sequence; identical to SEQ ID NO: 150656
  derived and/or modified sequence opt3 from neuraminidase__InfluenzaB__AFJ80220

SEQ ID NO: 151035 - RNA, 1401 nt, Artificial Sequence
  derived and/or modified sequence opt3 from neuraminidase__InfluenzaB__AFJ80231
augcugcccagcaccauccagacacucacucuuuuccugacguccggcgggguguuguuaucucuguacgucucagccagucuaagcuaucuccuguacuccgguauucuucugaaguuuucuuugaccgagauaacagcuccuacuaugccacucaacugcgcaaaugccucgaacguucaagcggugaauagaucagcuaccaaaggaguaacacuguuccugccggaacccgaguggaccuauccuaggcucagcuguccaggcaguacuuuucagaaggccuuacugaucucuccccaccgguucggggaaacaaaaggaaacuccgcaccucuuauuauccgcgagccauuuauugccugcggccccaaggaauguaaacauuucgcuuugacccacuacgcagcccagccugguggguauuacaauggaacgcgagaggaccguaacaagcugagacaucuaaucagcguggagcucggcaagauaccaacugucgaaaauuccaucuuucacauggcugccuggucaggcagugcgugccaugaugggaaagaguggaccuauauuggaguggacgguccggauagcaacgcacugcuuaagaucaaauacggcgaagccuacacagacacuuaucacucuuacgcuaauaacauucugaggacccaggaguccgccuguaauugcaucgggggagauuguuauuugaugauaacagacggcucagcaagcgguauuagugagugccgguuccucaagauccgcgaagggagaauuaucaaagagaucuuucccaccggaaggguugaacacacggaggaauguacuugcggcuucgcuucuaacaagacaauugagugugccugccgggauaauuccuacaccgcgaagcgcccuuuugugaaacugaacgucgagacugacacagccgaaauacgauuaaugugcaccgagacguaucuggauaccccaagacccgacgauggcagcaucacagggccuugugaaucgaauggagacaaggguucuggcgggauuaaaggaggcuucgugcaucaaaggauggcauccaagaucggucggugguacucacguacuaugaguaaaaccaagcgcauggggaugggccucuauguaaaauacgauggagacccauggauagacagcgaugcucuuacacuguccggcguuauggugucuauggaggaacccgggugguacagcuuuggauucgagauuaaggacaagaaaugcgaugucccguguaucgguaucgagauggugcacgacggcgggaagaaaacuuggcauucagccgcuaccgccauuuauugcuugaugggaaguggccagcuacugugggauacagugaccggugucgacauggcacucuga

SEQ ID NO: 151036 - RNA, 1401 nt, Artificial Sequence
  derived and/or modified sequence opt3 from neuraminidase__InfluenzaB__AFJ80242
augcugcccagcaccauccagacacucacucuuuuccugacguccggcgggguguuguuaucucuguacgucucagcccuacucaguuaucugcuuuacagcgacauucuguugaaguuuuccccuaccaaaguuauagcuccaacaaugucucucgauugcgcaaacgccucgaaugugcaagcgguaaaccacucagcuacugaggaaaugaccuuccugcugccggagcccgaauggacauauccuagacucagcugucagggaaguaccuuucagaaggccuuacugaucuccccacauagguucggugaggcaaaaggcaauucugcuccccuuauuauccgggaaccuuuuauugcuugcgggccaaaggaguguaaacacuucgcauugacucauuacgccgcucagcccggaggcuauuacaacgguacacgcgaggaccgaaauaagcugcgucaccuaaucagcgugaaccucgggaagauaccuaccgucgaaaauuccaucuuucauauggccgcguggucaggaagugcaugccacgauggcagagaguggacguauauuggcguggacgggccagauagcaacgcccugaucaaaauuaaguacggagaagccuacacugacaccuaucacucuuacgccaauaacauccuuaggacacaagaguccgcauguaauugcauagguggcgauuguuaucugaugauuacugacgggucagcuagcggaaucagucggugccgcuucuugaaaauuagagagggcaggaucaucaaggaaauuuuuccgaccggucggguugagcauacagaagaguguaccugcggguucgccucuaacaaaacgauagaaugugcgugccgcgauaauuccuacacugccaagcgacccuuugugaagcucaacgucgagacagacaccgcagagaucagacugaugugcacugaaacauauuuagauaccccuaggccagacgauggaagcauuacgggccccugugagucgaauggcgacaaagggaacggagguaucaagggcggguucgugcaccagcggauggcuucucguauaggacgcugguacuccagaaccaugucaaaaacaaagaggaugggcauggaacuguauguaaaauacgacggugauccuuggacugacagugaugcccucgcuccaagcgggguuaugguguccauggaggaacccggcugguacucuuuuggauucgagauuaaggacaaaaagugcgaugucccguguaucggcaucgagauggugcaugacgggggaaagaccacauggcacagcgccgcaacugccauuuauugccuuauggguucaggccagcuguugugggauaccgugacaggggucgacauggcucuauga

SEQ ID NO: 151037 - RNA, 1401 nt, Artificial Sequence
  derived and/or modified sequence opt3 from neuraminidase__InfluenzaB__AFJ80660
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcagggaauggaccuauauugggguggacggacccgauagcaaugcacugcuuaagaucaaauacggugaggccuacacagacacuuaucacucuuacgcuaacaauauucugcggacccaggaauccgccuguaacugcaucggcggggauuguuauuugaugauaacagacggaucagcaagcggcauuagugagugccgcuuucucaagaucagagaggguaggauuaucaaagaaaucuucccuaccgggcggguugagcacacggaagaguguacuugcggauuugcuucuaauaagacaauugaaugugccugccgcgauaacuccuacaccgcgaagcgaccauucgugaaacugaaugucgagacugacacagccgagauaagauuaaugugcaccgaaacguaucuggauacccccaggccugacgauggcagcaucacaggcccaugugagucgaacggggacaagggaucugguggcauuaaagggggauuugugcaucaacggaugacuuccaagaucggccguugguacucacgcaccaugaguaaaacaaagagaauggguauggggcucuauguaaaauacgacggcgaucccuggacugacagcgaugcacuugcucuguccggaguuauggugucuauggaggaaccgggcugguacagcuucggguuugaaauaaaggacaagaaaugcgaugucccuuguauuggaaucgagauggugcacgacgguggcaagaaaaccuggcauucagccgcuacagccaucuauugcuugauggggaguggacagcuacugugggauaccgugacuggcgucgacauggcacucuga

SEQ ID NO: 151038 - RNA, 1401 nt, Artificial Sequence; identical to SEQ ID NO: 151035
  derived and/or modified sequence opt3 from neuraminidase__InfluenzaB__AFJ80671

SEQ ID NO: 151039 - RNA, 1401 nt, Artificial Sequence; identical to SEQ ID NO: 151035
  derived and/or modified sequence opt3 from neuraminidase__InfluenzaB__AFJ80682

SEQ ID NO: 151040 - RNA, 1401 nt, Artificial Sequence
  derived and/or modified sequence opt3 from neuraminidase__InfluenzaB__AFJ80693
augcugcccagcaccauccagacacucacucuuuuccugacguccggcgggguguuguuaucucuguacgucucagccagucuaagcuaucuccuguacuccgguauucuucugaaguuuucuccuaccgagauaacagcuccaacuaugccguugaacugcgcaaaugccucgaacguucaagcggugaauagaucagcuaccaaaggaguaacacuccugcugcccgaaccugaguggaccuauccaaggcucagcugucccggcaguacuuuccagaaggccuuacugaucuccccucaccgguuuggggaaacaaaaggaaacucugcaccacuuauuauccgcgagcccuucauugccugcggcccuaaggaauguaaacauuuugcuuugacccacuacgcagcccagccagguggguauuacaauggaacgcgagaggaccguaacaagcugagacaucuaaucagcgugaagcucggcaaaauaccgacugucgaaaauuccaucuuccacauggcugccuggucaggcagugcgugccaugaugggagggaauggaccuauauuggaguggacggucccgauagcaacgcacugcuuaagaucaaauacggcgaggccuacacagacacuuaucacucuuacgcuaauaacauucugcggacccaggaauccgccuguaauugcaucgggggagauuguuauuugaugauaacagacggcucagcaagcgguauuagugagugccgcuuucucaagaucagagaggggaggauuaucaaagaaaucuucccuaccggacggguugagcacacggaagaguguacuugcggcuuugcuucuaacaagacaauugaaugugccugccgcgauaauuccuacaccgcgaagcgaccauucgugaaacugaacgucgagacugacacagccgagauaagauuaaugugcaccgaaacguaucuggauacccccaggccugacgauggcagcaucacagggccaugugagucgcauggagacaaggguucuggcgggauuaaaggaggcuuugugcaccaacggauggcauccaagaucggucguugguacucacgcacuaugaguaaaaccaagagaauggggaugggccucuauguaaaauacgauggagaccccuggauagacagcggcgcucuuacacuguccgggguuauggugucuauggaggagccgggaugguacagcuucgguuuugaaauuaaggauaagaaaugcgacgucccuuguaucggcaucgagauggugcaugaugggggaaagaaaacuuggcacucagccgcuaccgccauuuauugcuugaugggcaguggucagcuacugugggacacagugaccggggucgauauggcacucuga

SEQ ID NO: 151041 - RNA, 1401 nt, Artificial Sequence
  derived and/or modified sequence opt3 from neuraminidase__InfluenzaB__AFJ80726
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaaggaauguaaacauuuugcuuugacccacuacgcagcccagccuggcgguuauuacaacgggacgcgagaggaccguaauaagcugagacaucuaaucagcgugaagcucggaaaaauaccaacugucgagaacuccaucuuccacauggcugccuggucaggcagugcgugccaugauggcagggaauggaccuauauugggguggacggaccggauagcaaugcacugcuuaagaucaaauacggugaggccuacacagacacuuaucacucuuacgcuaagaacauucugcggacccaagaauccgccuguaauugcaucggcggggauuguuauuugaugauaacagacggaucagcaagcggcauuagugagugccgcuuucucaaaaucagagaggguaggauuaucaaggaaaucuuccccaccgggcggguuaagcacacggaggaauguacuugcggauuugcuucuaacaaaacaauugagugugccugccgcgauaauuccuacaccgcgaagcgaccuuucgugaaacugaacgucgaaacugacacagccgagauaagauuaaugugcaccgagacguaucuggauaccccaaggcccaaugacggcagcaucacaggcccuugugaaucgaacggggaucggggagguggcgggauuaagggaggcuuugugcaucagcguauggcaucuaaaaucggucgcugguacuccagaacuaugucaaagaccaaaaggauggggaugggccucuauguaaaguacgacggagacccauggacagauagugaggcucuugcccugagcggcguuauggugcccauggaggaaccggggugguacuccuucggauuugaaauaaaggacaaaaagugcgaugucccuuguauugguaucgagauggugcacgacggcgggaaaacuaccuggcauucugcugccacagcaaucuauugcuugaugggaagcggccagcuacugugggauaccgugacuggugucgacauggcccucuga

SEQ ID NO: 151042 - RNA, 1401 nt, Artificial Sequence
  derived and/or modified sequence opt3 from neuraminidase__InfluenzaB__AFJ80737
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcagggaauggacuuauaucgggguggacggaccggauagcaaugcacugcuuaagauuaaauacggugaggccuacaccgacacauaucacucuuacgcuaagaacauccugcggacucaagaauccgccuguaauugcauacgcggcgauuguuauuugaugauuaccgacgggcccgcaucaggaaucagcgagugcagauuucucaaaauuagggagggccggaucaucaaggaaauuuucccuacaggucgcguuaagcacaccgaggaauguacgugcggguuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggauccauuaccggcccaugugaaagcaacggcgauaaggggucgggagguaucaaaggcggguuugugcaucagcguauggcaucuaagauaggacgcugguacuccagaacaaugucaaaaacuaagaggaugggcaugggucucuauguaaaguacgacggggaccccuggaccgauagugaggcucuugcccugagcggcguuaugguguccauggaggaaccgggaugguacucuuucggcuuugaaauuaaagacaagaaaugcgaugucccuuguaucgggaucgagauggugcacgacggagguaagacaacuuggcauagcgcugccaccgcaauuuauugcuugaugggcucagggcagcuacugugggauacagugaccggagucgacauggcccucuga

SEQ ID NO: 151043 - RNA, 1401 nt, Artificial Sequence; identical to SEQ ID NO: 150684
  derived and/or modified sequence opt3 from neuraminidase__InfluenzaB__AFJ80759

SEQ ID NO: 151044 - RNA, 1401 nt, Artificial Sequence
  derived and/or modified sequence opt3 from neuraminidase__InfluenzaB__AFJ80770
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaacgaauguaagcauuuugcuuugacccacuacgcagcccagccuggcgguuauuacaaugggacgcgagaggaccguaacaaacugagacaucuaaucagcgugaagcucggaaagauaccaacugucgaaaauuccaucuuccacauggcugccuggucaggcagugcgugccaugauggcagggaauggaccuauauugggguggacggaccggauagcaacgcacugcuuaaaaucaaguacggugaggccuacacagacacuuaucacucuuacgcuaaaaauauucugcggacccaagaauccgccuguaacugcaucggcggggauuguuauuugaugauaacagacggacccgcaucaggcauuagcgagugccgcuuucucaagaucagagaggguaggauuaucaaagaaaucuucccuaccgggcggguuaagcacacggaggaauguacuugcggauuugcuaguaauaagacaauugagugugccugccgcgauaacucuuacaccgcgaaacgaccauucgugaagcuggacgucgaaacugauacagccgagauaagauuaaugugcaccgagacguaucuggacacccccaggccuaaugauggcuccaucacaggcccaugugaaagcaacggggacaaaggaucggguggcauuaaagggggauuugugcaucagcggauggcaucuaagaucggccguugguacucccgcacucucucaaagaccaaaagaauggguauggggcuuuauguaaaguacgacggcgaucccuggacagacagugaggcucuggccuugagcggaguuaugguguccauggaggagccgggcugguacucuuucggguuugaaauaaaggauaaaaagugcgacgucccuuguauuggaaucgagauggugcacgaugguggcaaaacuaccuggcauagcgcugccacagcaaucuauugccuaauggggucaggacagcugcucugggacaccgugacuggcgucgauauggcccuguga

SEQ ID NO: 151045 - RNA, 1401 nt, Artificial Sequence; identical to SEQ ID NO: 150684
  derived and/or modified sequence opt3 from neuraminidase__InfluenzaB__AFJ80785

SEQ ID NO: 151046 - RNA, 1401 nt, Artificial Sequence; identical to SEQ ID NO: 150684
  derived and/or modified sequence opt3 from neuraminidase__InfluenzaB__AFJ80796

SEQ ID NO: 151047 - RNA, 1401 nt, Artificial Sequence
  derived and/or modified sequence opt3 from neuraminidase__InfluenzaB__AFJ80807
augcugcccagcaccauccagacacucacucuuuuccugacguccggcgggguguuguuaucucuguacgucucaguuagucuaagcuaucuccuguacuccgacauucuucugaaguuuccuucuaccgagauaacagccccaacuaugccguuggauugcgcuaacgcaucgaaugugcaagccguaaacagaucagcgaccaaaggagugacacuccugcugcccgaaccugaguggaccuauccaaggcucagcugucccgguaguacuuuccagaaggcuuuacugaucuccccucaccgguuuggcgaaacaaaaggaaauucugccccacuuauuauccgcgagcccuucauugcaugcgggccuaaggaauguaaacauuuugccuugacccacuacgcugcacagccaggcgguuauuacaacgggacgcgaggagaccguaauaagcugagacaucuaaucagcgucaagcucggcaaaauaccgacuguggagaacuccaucuuccacauggccgcuuggucaggcagugccugccaugaugggaaggaguggaccuauauuggaguugacggucccgauaauaacgcgcugcuuaaaaucaaguacggcgaagcauacacagacacuuaucacagcuacgccaauaacauucugaggacccaggagucugcuuguaauugcaucgggggaaacuguuauuugaugauaacagauggcuccgccucaggugugagcgaaugccgguuucucaaaauucgcgaggggagaaucauuaaggagaucuucccuaccggaaggaucaagcacacggaagaguguacuugcggcuuugcaaguaauaaaacaauugaaugugcuugccgggacaacucuuacaccgccaagcgcccauucgucaaacugaauguggagacugauacagcggaaauacgauuaaugugcaccgagacguaucuggacacccccagaccugaugacggcuccaucacagggccaugugagagcaacggagauaaggguucgggcgggauuaaaggaggcuuuguacaucaaaggauggccucuaagaucggucggugguacucccguacuaugucaaaaaccaagcgcauggggaugggccucuauguuaaguacgacggagaccccugggcagauagugacgcucuugccuucagcggcgugauggucuccauggaggaaccggggugguacucuuuuggauucgaaauaaaagauaagaaaugcgacgugccuuguauugguaucgagauggugcacgauggcgggaaggaaacauggcauagcgcugccacugcaaucuauugccugaugggaucaggccaguugcuaugggacaccgucacagguguuaacauggcccuguga

SEQ ID NO: 151048 - RNA, 1401 nt, Artificial Sequence; identical to SEQ ID NO: 150684
  derived and/or modified sequence opt3 from neuraminidase__InfluenzaB__AFJ80818

SEQ ID NO: 151049 - RNA, 1401 nt, Artificial Sequence; identical to SEQ ID NO: 150684
  derived and/or modified sequence opt3 from neuraminidase__InfluenzaB__AFJ80829

SEQ ID NO: 151050 - RNA, 1401 nt, Artificial Sequence; identical to SEQ ID NO: 151021
  derived and/or modified sequence opt3 from neuraminidase__InfluenzaB__AFJ80840

SEQ ID NO: 151051 - RNA, 1401 nt, Artificial Sequence; identical to SEQ ID NO: 151021
  derived and/or modified sequence opt3 from neuraminidase__InfluenzaB__AFJ80851

SEQ ID NO: 151052 - RNA, 1401 nt, Artificial Sequence
  derived and/or modified sequence opt3 from neuraminidase__InfluenzaB__AFJ80862
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcgaugaacagaucagcuaccaaaggagugacacuccugcugcccgaaaccgaguggacuuauccuaggcucagcuguccagguaguacauuccagaaggccuuacugaucucuccccaccgguuuggcgaaaccaaaggaaauuccgcaccucuuauuauccgcgagccauucauugccugcgggcccaaggaauguaaacauuuugcuuugacgcacuacgcagcccagccuggcgguuauuacaacgggacucgaggagaccguaauaagcugagacaucuaaucagcguaaagcucggcaaaauaccaaccguggagaacuccaucuuccacauggcugccuggucaggcagugcgugccaugaugggaaggaguggacauauauuggagucgacgguccggauaauaacgcacugcuuaaaaucaaguacggcgaagccuacacugacaccuaucacagcuacgcuaauaacauucugaggacacaggagucugccuguaauugcaucgggggaaacuguuauuugaugauaaccgauggcuccgcaucaggugugagcgaaugccgguuucucaaaauucgcgaggggagaaucauuaaggagaucuuccccacgggaaggaucaagcacacugaagaguguacaugcggcuuugcuaguaauaaaaccauugaaugugccugccgggacaacucuuacacugcgaagcgcccuuucguuaaacugaauguggagacagauaccgccgaaauacgauuaaugugcacggagaccuaucuggacacaccaagacccgaugacggcuccaucacugggccuugugagagcaacggagauaaggguucgggcgggauuaaaggaggcuuuguccaucaaaggauggcaucuaagaucggucggugguacucccguaccaugucaaaaacagaacgcauggggaugggccucuaugugaaguacgacggagacccaugggcugauagugacgcccuuacuuucagcggcguaaugguuuccauggaggaacccgggugguacucuuuuggauucgagauaaaggauaaaaagugcgacgugccguguauugguaucgaaaugguccacgauggcgggaaagagaccuggcauagcgcugccacagcaaucuauugccugaugggaucaggccaguugcuaugggacaccgugacuggugugaacauggcccuguga

SEQ ID NO: 151053 - RNA, 1401 nt, Artificial Sequence
  derived and/or modified sequence opt3 from neuraminidase__InfluenzaB__AFJ80873
augcugcccagcaccauccagacacucacucuuuuccugacguccggcgggguguuguuaucucuguacgucucagccagucuaagccaccuccuguauuccgggauucuucugaaguuuccuucuaccgagauaacagcuccaacuaugccguuggacugcgcaaacgccucgaauguucaagcggugaacagaucagcuaccaaagguguaacacuccugcccccugaaccagaguggaccuaccccaggcugagcuguccuggcaguacuuuccagaaggcccucuuaaucuccccacaucgguuuggggaaacaaaaggaaauucugcaccccugauuauccgcgagccuuucauugccugcggcccaaaggaauguaaacacuuugcucuuacccauuaugcagcccagccggguggguacuauaacggaacgcgaggcgaucguaauaaguugagacaccugaucagcgugaagcuaggcaaaauacccacugucgagaacuccaucuuccauauggcugccuggucagggagugcgugccacgacggaaaggaguggaccuacauugguguggauggcccugacaauaacgcacuccugaaaaucaaguauggggaagccuacacagauacuuaccacagcuaugcuaauaacauucuuaggacccaggagucugccuguaauugcaucggaggcaacuguuaccugaugauaacagacgguuccgcaucagggguuagcgaaugccgguuuuugaaaauucgcgagggaagaaucauuaaggagaucuucccaaccggcaggaucaagcauacggaagaguguacuugcggcuuugcuaguaauaaaacaauugaaugugccugccgggauaacucuuauaccgcgaagcgccccuucgugaaacucaaugucgagacugacacagccgaaauacgacugaugugcaccgagacguacuuagauaccccuagaccagacgauggguccaucacaggacccugugagagcaacggugacaagggcucgggaggaauuaaaggcgguuuugugcaccaaaggauggcaucuaagaucgggcggugguauucccguacuaugucaaaaaccgaacgcaugggcaugggacuguacguaaaguaugauggcgacccgugggcugacagugaugcccucacauucagcgggguuaugguguccauggaggaaccuggaugguacucuuuugguuucgagauaaaggacaaaaagugcgauguccccuguauuggcaucgaaauggugcaugacgggggaaaagagacuuggcacagcgcugccaccgcaaucuacugccuuaugggcucaggucagcuguugugggauacagugaccggggucaacauggcccuauga

SEQ ID NO: 151054 - RNA, 1401 nt, Artificial Sequence
  derived and/or modified sequence opt3 from neuraminidase__InfluenzaB__AFJ80884
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcaaaugccgguuucucaagauucgcgaagggagaaucauuaaggagaucuucccuaccggaaggaucaaacacacggaggaauguacuugcggcuuugcuaguaauaagacaauugagugugccugccgggacaacucuuacaccgcgaaacgcccauucgugaagcugaaugucgaaacugauacagccgagauacgauuaaugugcaccgaaacguaucuggacacccccagaccugaugacggcuccaucacagggccaugugagagcaacggagauaaagguucgggcgggauuaagggaggcuuugugcaucaaaggauggcaucuaaaaucggucggugguacucccguacuaugucaaagaccgagcgcauggggaugggccucuauguaaaguacgacggagaccccugggcugauagugacgcccuuacauucagcggcguuaugguguccauggaggaaccggggugguacucuuuuggauucgaaauaaaagauaagaaaugcgacgucccuuguauugguaucgagauggugcacgauggcgggaaggaaacuuggcauagcgcugccaccgcaaucuauugccugaugggaucaggccaguugcuaugggacacagugaccggugucaacauggcccuguga

SEQ ID NO: 151055 - RNA, 1401 nt, Artificial Sequence; identical to SEQ ID NO: 151020
  derived and/or modified sequence opt3 from neuraminidase__InfluenzaB__AFJ80895

SEQ ID NO: 151056 - RNA, 1401 nt, Artificial Sequence
  derived and/or modified sequence opt3 from neuraminidase__InfluenzaB__AFJ80917
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaauguaccugccgggacaacucuuacacugccaagcgcccauucgugaaacugaaugucgagacagauaccgcggaaauacgauuaaugugcacggagaccuaucuggacacacccagaccugaugacggcuccaucacugggccaugugagagcaacggagauaaggguucgggcgggauuaaaggaggcuuugugcaucaaaggauggccucuaagaucggucggugguacucccguaccaugucaaaaacagaacgcauggggaugggccucuauguaaaguacgacggagaccccugggcagauagugacgcucuuacuuucagcggcguuaugguguccauggaggaaccggggugguacucuuuuggauucgagauaaaggauaaaaagugcgacgucccuuguauugguaucgaaauggugcacgauggcgggaaagagaccuggcauagcgccgcuacagccaucuauugccugaugggaucaggccaguugcuaugggacaccgugacuggugucaacauggcacuguga

SEQ ID NO: 151057 - RNA, 1401 nt, Artificial Sequence
  derived and/or modified sequence opt3 from neuraminidase__InfluenzaB__AFJ80928
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgaaccuaaggaguguaaacauuuugcuuugacccacuacgcagcccagccagggggcuauuacaacgguacgcgaggggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauaauaacgcacugcuuaaaaucaaguacggugaggccuacacagacacuuaucacagcuacgcuaauaacauucugaggacccaggaaucugccuguaauugcaucggcgggaacuguuauuugaugauaacagauggauccgcaucaggcguuagcgagugccgguuucucaaaauucgcgaggguagaaucauuaaggaaaucuucccuaccgggaggaucaagcacacggaggaauguacuugcggauuugcuaguaauaaaacaauugagugugccugccgggacaacucuuacaccgcgaagcgcccauucgugaaacugaaugucgaaacugauacagccgagauacgauuaaugugcaccgagacguaucuggacacccccagaccugaugacggcuccaucacaggcccaugugaaagcaacggggauaagggaucggguggcauuaaagggggauuugugcaucaaaggauggcaucuaagaucggccggugguacucccguacuaugucaaaaaccgagcgcauggguauggggcucuauguaaaguacgacggcgaccccugggcugauagugacgcccuuacauucagcggaguuaugguguccauggaggaaccgggcugguacucuuuuggguucgaaauaaaggauaaaaagugcgacgucccuuguauuggaaucgagauggugcacgaugguggcaaagagacuuggcauagcgcugccaccgcaaucuauugccugauggggucaggacaguugcuaugggacacagugaccggcgucaacauggcccuguga

SEQ ID NO: 151058 - RNA, 1401 nt, Artificial Sequence
  derived and/or modified sequence opt3 from neuraminidase__InfluenzaB__AFJ80939
augcugcccagcaccauccagacacucacucuuuuccugacguccggcgggguguuguuaucucuguacgucucagccagucuaagcuaucuccuguacuccgacauucuucugaaguuuccuccaaccgagguuacagcuccgacuaugcccuuggauugcgcaaacgccucuaaugugcaagcgguaaacagaucggcuaccaaaggagugacacuccugcugccugaaccagaguggaccuaucccaggcucucauguccugguagcacuuuccagaaggccuuacugauaaguccacaccgguuuggcgaaacaaaaggaaauuccgcaccccuuaucauucgcgagccuuucaucgccugcgggccaaaggaauguaaacauuuugcuuugacccacuacgcagcccagccgggcgguuauuacaacgggacgcgaggagaccguaauaagcugagacaucuaauuucugucaagcucggcaaaauccccacuguggagaacagcauauuccacauggcugccugguccggcucagcgugccaugaugggaaggaguggaccuauaucggaguugacgguccugauaauaacgcacugcuuaaaauuaaguacggcgaagccuacacagacacuuaucacaguuacgcuaauaacauccugaggacccaggagagcgccuguaauugcauugggggaaacuguuauuugaugaucacagauggcucugcauccggugugucagaaugccgguuucucaaaauacgcgaggggagaauuaucaaggagauuuucccaaccggaaggaucaagcacacggaagaguguacuugcggcuuugcuagcaauaaaacaaucgaaugugccugccgggacaacaguuacaccgcgaagcgccccuucgucaaacugaauguggagacugauacagccgaaauucgauuaaugugcaccgagacguaucuggacaccccuagaccagaugacggcucuauaacagggcccugugaguccaacggagauaaggguagcggcgggaucaaaggaggcuuuguacaucaaaggauggcaucgaagauuggucggugguacucucguacuauguccaaaaccgaacgcauggggaugggccucuauguuaaguacgacggagacccgugggcugauucagacgcccuuacauucaguggcgugauggucagcauggaggaaccugggugguacuccuuuggauucgagaucaaggauaaaaagugcgacgugcccuguauagguauugaaauggugcacgauggcgggaaagagacuuggcauucugcugccaccgcaaucuauugccugaugggaagcggccaguugcuaugggacacagucaccgguguuaacauggcccuguga

SEQ ID NO: 151059 - RNA, 1401 nt, Artificial Sequence
  derived and/or modified sequence opt3 from neuraminidase__InfluenzaB__AFJ80950
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaaacgguggcaucaaagggggauuugugcaucagaggauggcuucgaagauaggccggugguacucucguacaauguccaaaacuaagcgcauggguauggggcucuauguaaaguacgacggcgaucccuggaccgacucagaggcccuugcucugaguggaguuauggugagcauggaggaaccgggcugguacuccuucggguuugaaauuaaagauaagaaaugcgacgucccuuguaucggaaucgagauggugcacgaugguggcaagacaacuuggcauucugccgcaaccgccauuuauugcuugauggggagcggacagcuacugugggacacagugaccggcgucgauauggcucucuga

SEQ ID NO: 151060 - RNA, 1401 nt, Artificial Sequence; identical to SEQ ID NO: 151021
  derived and/or modified sequence opt3 from neuraminidase__InfluenzaB__AFJ80961

SEQ ID NO: 151061 - RNA, 1401 nt, Artificial Sequence; identical to SEQ ID NO: 150804
  derived and/or modified sequence opt3 from neuraminidase__InfluenzaB__AFJ80972

SEQ ID NO: 151062 - RNA, 1401 nt, Artificial Sequence; identical to SEQ ID NO: 150804
  derived and/or modified sequence opt3 from neuraminidase__InfluenzaB__AFJ80983

SEQ ID NO: 151063 - RNA, 1401 nt, Artificial Sequence; identical to SEQ ID NO: 150759
  derived and/or modified sequence opt3 from neuraminidase__InfluenzaB__AFJ80994

SEQ ID NO: 151064 - RNA, 1401 nt, Artificial Sequence; identical to SEQ ID NO: 150804
  derived and/or modified sequence opt3 from neuraminidase__InfluenzaB__AFJ81005

SEQ ID NO: 151065 - RNA, 1401 nt, Artificial Sequence; identical to SEQ ID NO: 150804
  derived and/or modified sequence opt3 from neuraminidase__InfluenzaB__AFJ84364

SEQ ID NO: 151066 - RNA, 1401 nt, Artificial Sequence
  derived and/or modified sequence opt3 from neuraminidase__InfluenzaB__AFJ90399
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaccgaugcccuuggauugcgcaaacgccucgaauguucaagcggugaacagaucagcuacuaaaggaguaacccuccugcugccugaaccagaguggacauaucccaggcucagcuguccugguaguaccuuccagcgggccuuacugaucuccccacaccgcuuuggcgaaacuaagggaaauucugcaccccuuauuauccgagagccuuucauugccugcgggccacgugaauguaaacauuuugcuuugacacacuacgcagcccagccgggcgguuauuacaacgggaccagaggagacaggaauaagcugcggcaucuaaucagcgugaaacucggcaagauacccacggucgagaacuccaucuuccacauggcugccuggucaggcagugcgugccaugaugggaaggaguggacuuauauuggaguggacgguccugauaauaacgcacugcuuaaaaucaaguacggcgaagccuacaccgacacauaucacagcuacgcuaauaacauucugcgcacucaggagucugccuguaauugcaucgggggaaacuguuauuugaugauaaccgauggcuccgcaucagguguuagcgaaugcagauuucucaaaauuagggaggggcggaucauuaaggagaucuucccaacaggacgcaucaaacacaccgaagaguguacgugcggcuuugcuaguaauaagacuauugaaugugccugccgagacaacucuuacacagcgaagagacccuucgugaaacugaaugucgagaccgauacugccgaaauaagguuaaugugcacagagaccuaucuggacacgccucggccagaugacggcuccaucaccgggcccugugagagcaacggagauaaggguucgggcgggauuaaaggaggcuuugugcaucaacguaugacaucuaagaucggucgcugguacuccagaacuaugucaaaaaccgaaaggauggggaugggccucuauguaaaguacgacggagacccgugggcagauagugacgcucuuacauucagcggcguuaugguguccauggaggaaccugggugguacucuuuuggauucgagauaaaagauaagaagugcgacguccccuguauugguaucgaaauggugcacgauggcgggaaagagacuuggcauagcgccgcuaccgccaucuauugccugaugggaucaggccaguugcuaugggacacagugaccggugucaacauggcacuguga

SEQ ID NO: 151067 - RNA, 1401 nt, Artificial Sequence
  derived and/or modified sequence opt3 from neuraminidase__InfluenzaB__AFJ90410
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccgaagcccgaauggaccuauccuaggcucagcuguccagguaguacauuccagaaagcauuacugauuucuccccaccgguuuggcgagaccaagggaaauuccgccccucuuaucauucgcgaaccauucaucgcuugcgggcccacugaguguaaacauuuugcauugacacacuacgccgcucagccuggcgguuauuacaacgggacccgagaagaccguaauaaccugagacaucuaauaagcgugaagcucggaaagaucccaacggucgaaaauuccauuuuccacauggccgcguggucaggcagugcaugccaugauggcaaagaguggacuuauaucgggguggacggaccggauagcaacgcccugcuuaagauuaaauacggugaggcuuacaccgacacauaucacucuuacgccaagaauauccugaggacucaagaguccgcauguaacugcauaggcggggauuguuauuugaugauuaccgacggacccgcuucaggcaucagcgaaugccgguuucucaaaauucgcgaggguagaaucaucaaggagauuuucccuacagggaggguuaagcacaccgaagaguguacgugcggauuugccaguaauaaaacuauagaaugugcgugccgggauaacucuuacacagccaagcgcccauucgugaaacugaaugucgagaccgacacugcagaaauccgauuaaugugcacagagaccuaucuggauacgcccagaccuaacgacggcuccauuaccggcccaugugagagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaagcccuugcucugagcggaguuaugguguccauggaggaaccgggcugguacucuuucggguuugagauuaaagauaagaaaugcgacgucccuuguaucggaaucgaaauggugcacgaugguggcaagacaacuuggcauagcgccgcaaccgccauuuauugcuugauggggucaggacagcuacugugggacacagugaccggcgucgauauggcucucuga

SEQ ID NO: 151068 - RNA, 1401 nt, Artificial Sequence
  derived and/or modified sequence opt3 from neuraminidase__InfluenzaB__AFJ90432
augcugcccagcaccauccagacacucacucuuuuccugacguccggcgggguguuguuaucucuguacgucucaaccagucuaagcuaucuccuguacuccgacauucuucugaaguuuucucaaacagagauaacugccccuaucaugccauuggauugcgcuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcucuauguaaaguacgacggcgaucccuggacagacagugaggcucuugcccugagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaauuuauugcuugauggggucaggacagcuacugugggacaccgugacuggcgucgauauggcccucuga

SEQ ID NO: 151069 - RNA, 1401 nt, Artificial Sequence; identical to SEQ ID NO: 150988
  derived and/or modified sequence opt3 from neuraminidase__InfluenzaB__AFJ90443

SEQ ID NO: 151070 - RNA, 1401 nt, Artificial Sequence
  derived and/or modified sequence opt3 from neuraminidase__InfluenzaB__AFJ90454
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucguuccauuggauugcgcaaacgccucgaaugugcaggcgguaaacagaucagcugccaaaggagugacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgaguauuacaacgguacccgagaggaccguaauaaacugagacaucuaauaagcgucaagcucgggaagaucccaacgguggaaaacuccauuuuccacauggccgcguggucaggaagugcaugccaugauggcaaagaguggacuuauaucggcguugacgggccggauagcaaugcccugcuuaagauuaaauacggagaggcuuacaccgacacauaucacucuuacgccaagaacauccugaggacucaagaauccgcauguaauugcauagguggcgauuguuauuugaugauuaccgacgggcccgcuucaggaaucagcgagugccgguuucucaaaauucgcgaaggcagaaucaucaaggagauuuucccuacagguagggugaagcacaccgaagaguguacgugcggguuugccaguaacaaaacuauagaaugugcgugccgggauaauucuuacacagccaagcgcccauucgucaaacugaacguggagaccgacacugcagagauccgauuaaugugcacagaaaccuaucuggauacgcccagaccuaaugacggauccauuaccggcccaugugagagcgauggcgacaaggggucgggagguaucaaaggcggguuuguacaucagaggauggcuucuaagauaggacggugguacucccguacaaugucaaaaacuaagcgcaugggcaugggucucuauguuaaguacgacggggaucccuggaccgacagugaagcccuugcucugagcggcgugauggucuccauggaggaaccgggaugguacucuuucggcuuugagauuaaagauaagaaaugcgacgugccuuguaucgggaucgagauggugcacgauggagguaagacaacuuggcauagcgccgcaaccgccauuuauugcuugaugggcucagggcagcuacugugggacacagucaccggaguugauauggcucucuga

SEQ ID NO: 151071 - RNA, 1401 nt, Artificial Sequence
  derived and/or modified sequence opt3 from neuraminidase__InfluenzaB__AFJ91042
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugauuccggaacccgaguggaccuauccuaggcugagcuguccagguaguacauuccagaaggcacucuuaaucucuccccaccgguuuggcgaaaccaaaggaaauuccgccccucugauuauccgcgagccauucauagcuugcgggcccacugaauguaagcauuuugcacuuacacacuacgccgcucagccuggcgguuauuacaacgggacccgagaggaccguaauaaauugagacaucugaucagcgugaagcuaggaaagauuccaacggucgagaacuccaucuuccacauggccgcguggucaggcagugcaugccaugauggcaaagaauggacuuauauugggguggacggaccggauagcaaugcccuccugaagaucaaauacggugaggcuuacaccgacacauaucacucuuacgccaagaacauacuuaggacucaagaauccgcauguaauugcauuggcggggauuguuaucugaugaucaccgacggacccgcuucaggcauuagcgagugccgguuuuugaaaauccgcgaggguagaaucauuaaggaaauauucccuacagggaggguuaagcacaccgaggaauguacgugcggauuugccaguaacaaaacuaucgagugugcgugccgggauaauucuuacacagccaagcgcccauucgugaaacucaacgucgaaaccgacacugcagagauucgacugaugugcacagagaccuauuuagauacgcccagaccuaaugacggcuccaucgcuggcccaugugaaagcgauggggacaagggaucggguggcauaaaagggggauuugugcaucagaggaugaccucuaagauuggccggugguacucccguacaaugucaaaaacuaagcgcauggguauggggcuguauguaaaguacgacggcgaucccuggaccgacagugaggcccucgcucuuagcggaguuaugguguccauggaggaaccgggcugguacucuuucggguuugaaaucaaagauaagaaaugcgacgucccuuguaucggaauugagauggugcacgaugguggcaagacaacuuggcauagcgccgcaaccgccaucuauugccugauggggucaggacaguugcuaugggacacagugaccggcgucgauauggcucuguga

SEQ ID NO: 151072 - RNA, 1401 nt, Artificial Sequence
  derived and/or modified sequence opt3 from neuraminidase__InfluenzaB__AFJ91053
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaagaaguaacucuccugcugccggagcccgaauggaccuauccuaggcucagcuguccaggaaguacauuccagaaggcauuacugauuucuccccaccgguuuggugagaccaaaggcaauuccgccccucuuaucauucgcgaaccauucaucgcuugcgggcccacugaguguaagcauuuugcauugacacacuacgccgcucagccuggaggcuauuacaacgguacccgagaggaccguaauaaacugagacaucuaauaagcgugaagcucgggaagaucccaacggucgaaaacuccauuuuccacauggccgcguggucaggaagugcaugccaugauggcaaagaguggacuuauaucggcguggacgggccggauagcaaugcccugcuuaagauuaaauacggagaggcuuacaccgacacauaucacucuuacgccaagaacauccugaggacucaagaauccgcauguaauugcauagguggcgauuguuauuugaugauuaccgacgggcccgcuucaggaaucagcgagugccgguuucucaaaauucgcgaaggcagaaucaucaaggagauuuucccuacagguaggguuaagcacaccgaagaguguacgugcggguuugccaguaacaaaacuauagaaugugcgugccgggauaauucuuacacagccaagcgcccauucgugaaacugaacgucgagaccgacacugcagagauccgauuaaugugcacagaaaccuaucuggauacgcccagaccuaaugacggauccauuaccggcccaugugagagcgauggcgacaaggggucgggagguaucaaaggcggguuugugcaucagaggauggcuucuaagauaggacggugguacucccguacaaugucaaaaacuaagcgcaugggcaugggucucuauguaaaguacgacggggaucccuggaccgacagugaagcccuugcucugagcggcguuaugguguccauggaggaaccgggaugguacucuuucggcuuugagauuaaagauaagaaaugcgacgucccuuguaucgggaucgagauggugcacgauggagguaagacaacuuggcauagcgccgcaaccgccauuuauugcuugaugggcucagggcagcuacugugggacacagugaccggagucgauauggcucucuga

SEQ ID NO: 151073 - RNA, 1401 nt, Artificial Sequence
  derived and/or modified sequence opt3 from neuraminidase__InfluenzaB__AFJ91075
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaauacccugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcucuauguaaaguacgacggcgaucccuggacagacagugaggcucuugcccugagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaauuuauugcuugauggggucaggacagcuacugugggacaccgugacuggcgucgauauggcccucuga

SEQ ID NO: 151074 - RNA, 1401 nt, Artificial Sequence; identical to SEQ ID NO: 150833
  derived and/or modified sequence opt3 from neuraminidase__InfluenzaB__AFJ91086

SEQ ID NO: 151075 - RNA, 1401 nt, Artificial Sequence; identical to SEQ ID NO: 150833
  derived and/or modified sequence opt3 from neuraminidase__InfluenzaB__AFJ91097

SEQ ID NO: 151076 - RNA, 1401 nt, Artificial Sequence; identical to SEQ ID NO: 150833
  derived and/or modified sequence opt3 from neuraminidase__InfluenzaB__AFJ91108

SEQ ID NO: 151077 - RNA, 1401 nt, Artificial Sequence; identical to SEQ ID NO: 150833
  derived and/or modified sequence opt3 from neuraminidase__InfluenzaB__AFJ91119

SEQ ID NO: 151078 - RNA, 1401 nt, Artificial Sequence; identical to SEQ ID NO: 150684
  derived and/or modified sequence opt3 from neuraminidase__InfluenzaB__AFJ91707

SEQ ID NO: 151079 - RNA, 1401 nt, Artificial Sequence
  derived and/or modified sequence opt3 from neuraminidase__InfluenzaB__AFK09801
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaaggaauguaaacauuuugcuuugacccacuacgcagcccagccuggcgguuauuacaacgggacgcgagaggaccguaauaagcugagacaucuaaucagcgugaagcucggaaaaauaccaacugucgagaacuccaucuuccacauggcugccuggucaggcagugcgugccaugauggcagggaauggaccuauauugggguggacggaccggauagcaaugcacugcuuaagaucaaauacggugaggccuacacagacacuuaucacucuuacgcuaagaacauucugcggacccaagaauccgccuguaauugcaucggcggggauuguuauuugaugauaacagacggaucagcaagcggcauuagugagugccgcuuucucaaaaucagagaggguaggauuaucaaggaaaucuuccccaccgggcggguuaagcacacggaggaauguacuugcggauuugcuucuaacaaaacaauugagugugccugccgcgauaauuccuacaccgcgaagcgaccuuucgugaaacugaacgucgaaacugacacagccgagauaagauuaaugugcaccgagacguaucuggauaccccaaggcccaaugacggcagcaucacaggcccuugugaaucgaacggggaucggggaucugguggcauuaaagggggauuugugcaucagcguauggcauccaagaucggccgcugguacucaagaacuaugaguaagaccaaaaggauggguauggggcucuauguaaaguacgacggcgacccauggacagauagcgaggcucuugcccuguccggaguuauggugcccauggaggaaccgggcugguacucuuucggguuugaaauaaaggacaaaaagugcgaugucccuuguauuggaaucgagauggugcacgacgguggcaaaacuaccuggcauagcgcugccacagcaaucuauugcuugauggggucaggacagcuacugugggauaccgugacuggcgucgacauggcccucuga

SEQ ID NO: 151080 - RNA, 1401 nt, Artificial Sequence; identical to SEQ ID NO: 150808
  derived and/or modified sequence opt3 from neuraminidase__InfluenzaB__AFN54669

SEQ ID NO: 151081 - RNA, 1401 nt, Artificial Sequence; identical to SEQ ID NO: 150808
  derived and/or modified sequence opt3 from neuraminidase__InfluenzaB__AFN54680

SEQ ID NO: 151082 - RNA, 1401 nt, Artificial Sequence; identical to SEQ ID NO: 150833
  derived and/or modified sequence opt3 from neuraminidase__InfluenzaB__AFN54691

SEQ ID NO: 151083 - RNA, 1401 nt, Artificial Sequence; identical to SEQ ID NO: 150833
  derived and/or modified sequence opt3 from neuraminidase__InfluenzaB__AFN54702

SEQ ID NO: 151084 - RNA, 1401 nt, Artificial Sequence; identical to SEQ ID NO: 150833
  derived and/or modified sequence opt3 from neuraminidase__InfluenzaB__AFN54713

SEQ ID NO: 151085 - RNA, 1401 nt, Artificial Sequence; identical to SEQ ID NO: 150833
  derived and/or modified sequence opt3 from neuraminidase__InfluenzaB__AFN54724

SEQ ID NO: 151086 - RNA, 1401 nt, Artificial Sequence; identical to SEQ ID NO: 150833
  derived and/or modified sequence opt3 from neuraminidase__InfluenzaB__AFN54735

SEQ ID NO: 151087 - RNA, 1401 nt, Artificial Sequence; identical to SEQ ID NO: 150833
  derived and/or modified sequence opt3 from neuraminidase__InfluenzaB__AFN54746

SEQ ID NO: 151088 - RNA, 1401 nt, Artificial Sequence; identical to SEQ ID NO: 150833
  derived and/or modified sequence opt3 from neuraminidase__InfluenzaB__AFN54757

SEQ ID NO: 151089 - RNA, 1401 nt, Artificial Sequence; identical to SEQ ID NO: 150833
  derived and/or modified sequence opt3 from neuraminidase__InfluenzaB__AFN54768

SEQ ID NO: 151090 - RNA, 1401 nt, Artificial Sequence; identical to SEQ ID NO: 150833
  derived and/or modified sequence opt3 from neuraminidase__InfluenzaB__AFN54779

SEQ ID NO: 151091 - RNA, 1401 nt, Artificial Sequence; identical to SEQ ID NO: 150833
  derived and/or modified sequence opt3 from neuraminidase__InfluenzaB__AFN54790

SEQ ID NO: 151092 - RNA, 1401 nt, Artificial Sequence; identical to SEQ ID NO: 150833
  derived and/or modified sequence opt3 from neuraminidase__InfluenzaB__AFN54801

SEQ ID NO: 151093 - RNA, 1401 nt, Artificial Sequence; identical to SEQ ID NO: 150833
  derived and/or modified sequence opt3 from neuraminidase__InfluenzaB__AFN54812

SEQ ID NO: 151094 - RNA, 1401 nt, Artificial Sequence
  derived and/or modified sequence opt3 from neuraminidase__InfluenzaB__AFN54834
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggaucuauauugggguggacggaccggauagcaaugcacugcuuaagaucaaauacggugaggccuacacugacaccuaucacucuuacgcuaagaacauacugcgcacacaggaauccgccuguaauugcauuggcggggauuguuauuugaugaucacugacggacccgcaucaggcauuagcgagugcagauuucucaaaaucagggagggucggaucauuaaggaaauauucccuaccgggcgcguuaagcacacagaggaauguaccugcggauuugcuaguaacaaaacgaucgagugugccugccgagauaauucuuacacugcgaagagaccauucgugaaacugaacgucgaaacagacaccgccgagauuagguuaaugugcacugagacauaucuggauacgccccggccuaaugacggcuccaucaccggcccaugugaaagcaacggggauaagggaucggguggcauaaaagggggauuugugcaucaacguauggcaucuaagauuggccgcugguacuccagaaccaugucaaaaacaaagaggauggguauggggcucuauguaaaguacgacggcgaccccuggacugauagugaggcucuugcccugagcggaguuaugguguccauggaggaaccgggcugguacucuuucggguuugaaaucaaagacaagaaaugcgaugucccuuguaucggaauugagauggugcacgacgguggcaagaccacauggcauagcgcugccacugcaaucuauugcuugauggggucaggacagcuacugugggauaccgugacaggcgucaauaugacccucuga

SEQ ID NO: 151095 - RNA, 1401 nt, Artificial Sequence; identical to SEQ ID NO: 150833
  derived and/or modified sequence opt3 from neuraminidase__InfluenzaB__AFN54845

SEQ ID NO: 151096 - RNA, 1401 nt, Artificial Sequence
  derived and/or modified sequence opt3 from neuraminidase__InfluenzaB__AFN54856
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcguuagcgagugcagauuucucaaaaucagggagggucggauuaucaaggaaaucuucccuacagggcgcgugaagcacaccgaggaauguacgugcggauuugcuaguaacaaaacuauugagugugccugccgagauaauucuuacacagcgaagagaccauucgucaaacugaacguggaaaccgacacugccgagauaagguuaaugugcacagagaccuaucuggauacgccccggccuaaugacggcuccaucaccggcccaugugaaagcaacggggauaagggaucggguggcauuaaagggggauuuguacaucaacguauggcaucuaagaucggccgcugguacuccagaacaaugucaaaaacuaagaggauggguauggggcucuauguuaaguacgacggcgaccccuggaccgauagugaggcucuugcccugagcggagugauggucuccauggaggaaccgggcugguacucuuucggguuugaaauaaaagacaagaaaugcgaugugccuuguauuggaaucgagauggugcacgacgguggcaagacaacuuggcauagcgcugccaccgcaaucuauugcuugauggggucaggacagcuacugugggauacagccaccggcgucaauaugacucucuga

SEQ ID NO: 151097 - RNA, 1401 nt, Artificial Sequence; identical to SEQ ID NO: 150833
  derived and/or modified sequence opt3 from neuraminidase__InfluenzaB__AFN54867

SEQ ID NO: 151098 - RNA, 1401 nt, Artificial Sequence
  derived and/or modified sequence opt3 from neuraminidase__InfluenzaB__AFU34598
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaguaacauuccuccugccggaacccgaguggaccuauccuaggcugaguuguccagguuccacuuuucagaaggcccucuuaaucucuccccaccgguucggcgaaacaaaagggaauagcgcaccucugauuauccgcgagccauuuauugccugcggacccaacgaauguaagcauuucgcucuuacccacuacgcagcccagccuggcgguuauuacaaugggacgcgaggagaccguaacaaauugagacaucugaucuccgugaagcuaggcaagauaccaacugucgaaaauucaaucuuucacauggcugccuggaguggcagcgcgugccaugaugggaaagaguggaccuauauuggaguggacgguccggauaacaaugcacuccugaagguuaaauacggcgaggccuacacagacacuuaucacucuuacgcuaacaagauccuuaggacccgggaguccgccuguaauugcauugggggaaacuguuaucugaugaucacagauggcucagcaagcggugugagugaaugccgcuucuugaaaauaagagucgggaggauuaucaaggagauuuuucccaccggacgggugaagcacacggaggaauguacuugcggcuucgcuucuaauaaaacaaucgagugugccugccgcgacaacuccuacaccgcgaagcgaccuuuuguaaaacucaauguugaaacugauacagccgagaucagacugaugugcaccgacacguauuuagauaccccaaggcccgacgauggcagcauuacagggccuugugaaucgaacggagacaaggguucuggcgggauaaaaggaggcuucgugcaucagcggauggaguccaagaucggucguugguacucacgcacuaugaguaaaaccgagagaauggggaugggccuguaugucaaguacgacggagauccaugggcagacagcgaugcucucgccuuuuccggcgugauggugucuaugaaggaacccgggugguacagcuucggauucgagauuaaagacaagaaaugcgaugucccguguaucgguauagaaaugguucacgacggcgggaaggagacauggcauucagcugccacugcaauuuauugccuuaugggaaguggccaacuguugugggauaccgugacagguguagacguggcccuauga

SEQ ID NO: 151099 - RNA, 1401 nt, Artificial Sequence
  derived and/or modified sequence opt3 from neuraminidase__InfluenzaB__AFU34609
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaggggaguaacauuccugcugccggaacccgagugggccuauccucggcucagcuguccagguaguaccuuucagaaagcauuacugaucucuccccaccgcuucggcgaaacuaagggaaauuccgccccucuuauuauccgagagccauuuauugcuugcgggcccaacgaauguaaacauuucgcauugacacacuacgccgcucagccuggcgguuauuacaaugggacccguggagacagaaacaagcugaggcaucuaaucagcgugaaacucggcaagauaccaacggucgaaaauuccaucuuucacauggccgcguggucaggcagugcaugccaugaugggaaggaguggacuuauauuggaguggacgguccggauaacgacgcccugcuuaaaguuaaguacggcgaggcuuacaccgauacauaucacagcuacgccaauaaaauccugcggacucaggagucugcauguaacugcauugggggaaauuguuauuugaugaucaccgacggcuccgcuucaggugugagcgaaugccgcuuccucaagauaagagaggggaggauuaucaaagagauuuuucccacaggacgggucaagcacaccgaagaguguacgugcggcuucgccaguaacaagacuaucgaaugugcgugccgcgauaauucuuacacagccaaacgaccuuuugugaagcugaacguagagaccgacacugcagaaaucagauuaaugugcacagauaccuaucuggacacgccaaggcccgaugacggcuccauuaccgggccuugugagagcaauggagacaaagguucgggcgggauaaagggaggcuucguucaucaacggauggagucuaaaaucggucguugguacucccgcacaaugucaaagacugaaagaauggggaugggccucuaugugaaauacgauggagacccaugggcugauagugacgcccuugcuuuuagcggcgucaugguguccaugaaggagcccgggugguacucuuucggauucgaaauuaaggauaaaaagugcgacgugccguguaucgguauagagaugguccacgauggcgggaaagaaaccuggcauagcgccgcaacagccauuuauugccugaugggaucaggccaguugcuaugggacacuguuaccgguguggauauggcucuguga

SEQ ID NO: 151100 - RNA, 1401 nt, Artificial Sequence
  derived and/or modified sequence opt3 from neuraminidase__InfluenzaB__AFU34620
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaggggaguaacauuccugcugccggaacccgaguggaccuauccucggcucagcuguccagguaguacuuuucagaaagccuuacugaucucuccccaccgcuucggcgaaacaaagggaaauuccgcaccucuuauuauccgagagccauuuauugccugcgggcccaacgaauguaaacauuucgcuuugacccacuacgcagcccagccuggcgguuauuacaaugggacgcguggagacagaaacaagcugaggcaucuaaucagcgugaaacucggcaagauaccaacugucgaaaauuccaucuuucacauggcugccuggucaggcagugcgugccaugaugggaaggaguggaccuauauuggaguggacgguccggauaacgacgcacugcuuaaaguuaaguacggcgaggccuacacagauacuuaucacagcuacgcuaauaaaauccugcggacccaggagucugccuguaacugcauugggggaaauuguuauuugaugaucacagacggcuccgcaucaggugugagcgaaugccgcuuccucaagauaagagaggggaggauuaucaaagagauuuuucccaccggacgggucaagcacacggaagaguguacuugcggcuucgcuaguaacaagacaaucgaaugugccugccgcgauaauucuuacaccgcgaaacgaccuuuugugaagcugaacguagagacugacacagccgaaaucagauuaaugugcaccgauacguaucuggacaccccaaggcccgaugacggcuccauuacagggccuugugagagcaauggagacaaagguucgggcgggauaaagggaggcuucguucaucaacggauggagucuaaaaucggucguugguacucccgcacuaugucaaagaccgaaagaauggggaugggccucuaugugaaauacgauggagacccaugggcagauagugacgcucuugccuuuagcggcgucaugguguccaugaaggagcccgggugguacucuuucggauucgaaauuaaggauaaaaagugcgacgugccguguaucgguauagagaugguccacgauggcgggaaagaaacauggcauagcgcugccacugcaauuuauugccugaugggaucaggccaguugcuaugggacaccguuacagguguggauauggcccuguga

SEQ ID NO: 151101 - RNA, 1401 nt, Artificial Sequence
  derived and/or modified sequence opt3 from neuraminidase__InfluenzaB__AFU34631
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaggggaguaacauuccugcugccggaacccgaguggaccuauccucggcucagcuguccagguaguacuuuucagaaagccuuacugaucucuccccaccgcuucggcgaaacaaagggaaauuccgcaccucuuauuauccgagagccauuuauugccugcgggcccaacgaauguaaacauuucgcuuugacccacuacgcagcccagccuggcgguuauuacaaugggacgcguggagacagaaacaagcugaggcaucuaaucagcgugaaacucggcaagauaccaacugucgaaaauuccaucuuucacauggcugccuggucaggcagugcgugccaugaugggaaggaguggaccuauauuggaguggacgguccggauaacgacgcacugcuuaaaguuaaguacggcgaggccuacacagauacuuaucacagcuacgcuaauaaaauccugcggacccaggagucugccuguaacugcauucgcgggaauuguuauuugaugaucacagacggauccgcaucaggcgugagcgaaugcagauuccucaagauaagggagggucggauuaucaaagagauuuuucccaccgggcgcgucaagcacacggaagaguguacuugcggauucgcuaguaacaagacaaucgaaugugccugccgagauaauucuuacaccgcgaaaagaccuuuugugaagcugaacguagagacugacacagccgaaaucagguuaaugugcaccgauacguaucuggacaccccacggcccgaugacggcuccauuacaggcccuugugagagcaauggggacaaaggaucggguggcauaaaagggggauucguucaucaacguauggagucuaagaucggccgcugguacuccagaacuaugucaaagaccgaaaggauggguauggggcucuaugugaaauacgauggcgacccaugggcagauagugacgcucuugccuuuagcggagucaugguguccaugaaggagcccggcugguacucuuucggguucgaaauuaaggauaaaaagugcgacgugccguguaucggaauagagaugguccacgaugguggcaaagaaacauggcauagcgcugccacugcaauuuauugccugauggggucaggacaguugcuaugggacaccguuacaggcguggauauggcccuguga

SEQ ID NO: 151102 - RNA, 1401 nt, Artificial Sequence
  derived and/or modified sequence opt3 from neuraminidase__InfluenzaB__AFU34642
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaaugacauuccuccugccggaacccgaguggaccuauccuaggcugaguuguccagguuccacuuuucagaaggcccucuuaaucucuccccaccgguucggcgaaacaaaagggaauagcgcaccucugauuauccgcgagccauuuauugccugcggacccaacggcuguaagcauuucgcucuuacccacuacgcagcccagccugguggguauuacaauggaacgcgaggcgaccguaacaaauugagacaucugaucuccguaaagcuaggcaagauaccaacuguggaaaauucaaucuuucacauggcugccuggagugggagcgcgugccaugauggaaaagaguggaccuauauuggugucgacggcccggauaacaaugcacuccugaaggugaaauacggggaggccuacacagacacuuaucacucuuacgcuaacaagauccuuaggacccaggaauccgccuguaauugcauuggaggcaacuguuaucugaugaucacagaugguucagcaagcgggguuagugagugccgguucuugaaaauacgcgaaggaagaauuaucaaggagauuuuucccaccggcagggugaagcacacggaggaauguacuugcggcuucgcuucuaauaaaacaaucgagugugccugccgggacaacuccuacaccgcgaagcgcccuuuugucaaacucaauguggaaacugauacagccgagauccgacugaugugcaccgacacguauuuagauaccccaagacccgacgaugggagcauuacaggaccuugugaaucguacggugacaagggcucugggggaauaaaaggcgguuucguacaucaaaggauggaguccaagaucgggcggugguauucacguacuaugaguaaaaccgagcgcaugggcaugggacuguacguuaaguacgacggcgauccaugggcagacagcgaugcucucgccuuuuccggggugauggucucuaugaaggaacccggaugguauagcuucgguuucgagauuaaagacaagaaaugcgaugugccguguaucggcauagaaauggugcacgacgggggaaaggagacauggcauucagcugccacugcaauuuacugccuuaugggcaguggucagcuguugugggauaccgucacagggguugacauggcccuauga

SEQ ID NO: 151103 - RNA, 1401 nt, Artificial Sequence
  derived and/or modified sequence opt3 from neuraminidase__InfluenzaB__AGB97261
augcugcccagcaccauccagacacucacucuuuuccugacguccggcgggguguuguuaucucuguacgucucagccagucuaagcuaucuccuguacuccgacaugcuucugaaguuuucuagaaccgagauuacagcuccuauaaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugaucucuccccaccgcuuuggcgaaacuaaaggaaauuccgcaccucuuauuauccgagagccauucauugccugcgggcccaaggaauguaaacauuuugcuuugacacacuacgcagcccagccuggcgguuauuacaacgggacccgugaggacagaaauaagcugaggcaucuaaucagcgugaagcucggaaaaauaccaacggucgagaacuccaucuuccacauggcugccuggucaggcagugcgugccaugauggccgggaauggacuuauauugggguggacggaccggauagcaaugcacugcuuaagaucaaauacggugaggccuacaccgacacauaucacucuuacgcuaagaacauucugcgcacucaggaauccgccuguaauugcaucggcggggauuguuauuugaugauaaccgacggacccgcaucaggcauuagcgagugcagauuucucaaaaucagggagggucggauuaucaaggaaaucuucccuacagggcgcguuaagcacaccgaggaauguacgugcggauuugcuaguaacaaaacuauugagugugccugccgagauaauucuuacacagcgaagagaccauucgugaaacugaacgucgaaaccgacacugccgagauaagguuaaugugcacagagaccuaucuggauacgccccggccuaaugacggcuccaucaccggcccaugugaaagcaacggggauaagggaucggguggcauuaaagggggauuugugcaucaacguauggcaucuaagaucggccgcugguacuccagaacaaugucaaaaacuaagaggauggguauggggcucuauguaaaguacgacggcgaccccuggaccgauagugaggcucuugcccugagcggaguuaugguguccauggaggaaccgggcugguacucuuucggguuugaaauaaaagacaagaaaugcgaugucccuuguauuggaaucgagauggugcacgacgguggcaagacaacuuggcauagcgcugccaccgcaaucuauugcuugauggggucaggacagcuacugugggauacagugaccggcgucaauaugacucucuga

SEQ ID NO: 151104 - RNA, 1401 nt, Artificial Sequence
  derived and/or modified sequence opt3 from neuraminidase__InfluenzaB__AGB97267
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaaucaaaggaaauuccgcaccucuuauuauccgcgagccauucauagccugcgggcccacugaauguaagcauuuugcuuugacacacuacgcagcccagccuggcgguuauuacaacgggacccgagaggaccguaauaaacugagacaucuaaucagcgugaagcucggaaagauuccaacggucgagaacuccaucuuccacauggcugccuggucaggcagugcgugccaugauggcaaagaauggacuuauauugggaucgacggaccggauagcaaugcacugcuuaagauaaaauacggugaggccuacaccgacacauaucacucuuacgcuaagaacauucugaggacucaagaauccgccuguaauugcaucggcggggauuguuauuugaugauuaccgacggacccgcaucaggcgugagcgagugccgguuucucaaaauccgcgaggguagaaucauuaaggaaauauucccuacagggaggguuaagcacaccgaggaauguacgugcggauuugcuaguaacaaaacuaucgagugugccugccgggauaaucgcuacacagcgaagcgaccauucgugaaacugaacgucgaaaccgacacugccgagauuagauuaaugugcacagagaccuaucuggauacgcccaggccuaaugacggcucuaucaccggcccaugugaauccgauggggacaagggaagcgguggcauaaaagggggauuugugcaucagcggauggcaucgaagauuggccguugguacucucgcacaauguccaaaacuaagagaauggguauggggcucuauguaaaguacgacggcgaucccuggaccgacucagaggcucuugcccugaguggaguuauggugagcauggaggaaccgggcugguacuccuucggguuugaaaucaaagauaagaaaugcgacgucccuuguaucggaauugagauggugcacgaugguggcaagacaacuuggcauucugcugccaccgcaaucuauugcuugauggggagcggacagcuacugugggacacagugaccggcgucgauauggcccucuga

SEQ ID NO: 151105 - RNA, 1401 nt, Artificial Sequence; identical to SEQ ID NO: 150833
  derived and/or modified sequence opt3 from neuraminidase__InfluenzaB__AGR54784

SEQ ID NO: 151106 - RNA, 1401 nt, Artificial Sequence; identical to SEQ ID NO: 150698
  derived and/or modified sequence opt3 from neuraminidase__InfluenzaB__AGX15491

SEQ ID NO: 151107 - RNA, 1401 nt, Artificial Sequence
  derived and/or modified sequence opt3 from neuraminidase__InfluenzaB__AGX15533
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggaaacgaggagaccguaacaagcugagacaucuaaucagcgugaagcucggcaaaauaccgacggucgaaaauuccaucuuccacauggcugccuggucaggcagugcgugccaugaugggaaggaguggacuuauauuggaguggacggucccgauaacaaugcacugcuuaaaaucaaguacggcgaggccuacaccgacacauaucacagcuacgcuaacaauauucugaggacucaggagucugccuguaacugcaucgggggaaauuguuauuugaugauaaccgauggcuccgcaucagguguuagcgaaugccgguuucucaaaauucgcgaggggagaaucauuaaggagaucuucccuacaggaagggugaagcacaccgaagaguguacgugcggcuuugcuaguaacaaaacuaucgaaugugccugccgggacaauucuuacacagcgaagcgcccauucgucaaacugaacguggagaccgauacugccgaaauucgauuaaugugcacagacaccuaucuggauacgcccagaccugacgauggcuccauaaccgggccaugugagagcaacggagacaaggguucgggcgggaucaaaggaggcuuuguacaucaaaggauggcaucuaagguuggucggugguacucccguacaaugucaaaaacugagcgcauggggaugggccucuaugugaaguacgacggagaucccugggcugacagugaugcccuugcuuucagcggcgucaugguguccaugaaggaaccggggugguacucuuuuggauucgagauuaaagacaagaaaugcgaugugccuuguaucgguauagaaaugguccacgacggcgggaaggagaccuggcauagcgccgcaacagccauuuauugccugaugggaucaggccaguugcuaugggauacuguuaccgguguggacauggcucuguga

SEQ ID NO: 151108 - RNA, 1401 nt, Artificial Sequence; identical to SEQ ID NO: 150651
  derived and/or modified sequence opt3 from neuraminidase__InfluenzaB__AGX15545

SEQ ID NO: 151109 - RNA, 1401 nt, Artificial Sequence; identical to SEQ ID NO: 150651
  derived and/or modified sequence opt3 from neuraminidase__InfluenzaB__AGX15556

SEQ ID NO: 151110 - RNA, 1401 nt, Artificial Sequence
  derived and/or modified sequence opt3 from neuraminidase__InfluenzaB__AGX15567
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccgaacgcauggggaugggccucuauguaaaguacgacggagaccccugggcugauagugacgcccuugcuuucagcggcguuaugguguccauggaggaaccggggugguacucuuuuggauucgagauaaaggauaaaaagugcgacgucccuuguauugguaucgaaauggugcacgauggcgggaaagagacauggcauagcgccgcaacugccaucuauugccugaugggaucaggccaguugcuaugggacaccgugacaggugucaacauggcucuguga

SEQ ID NO: 151111 - RNA, 1401 nt, Artificial Sequence; identical to SEQ ID NO: 150651
  derived and/or modified sequence opt3 from neuraminidase__InfluenzaB__AGX15578

SEQ ID NO: 151112 - RNA, 1401 nt, Artificial Sequence; identical to SEQ ID NO: 150651
  derived and/or modified sequence opt3 from neuraminidase__InfluenzaB__AGX15589

SEQ ID NO: 151113 - RNA, 1401 nt, Artificial Sequence; identical to SEQ ID NO: 150857
  derived and/or modified sequence opt3 from neuraminidase__InfluenzaB__AGX15600

SEQ ID NO: 151114 - RNA, 1401 nt, Artificial Sequence; identical to SEQ ID NO: 150857
  derived and/or modified sequence opt3 from neuraminidase__InfluenzaB__AGX15611

SEQ ID NO: 151115 - RNA, 1401 nt, Artificial Sequence; identical to SEQ ID NO: 150977
  derived and/or modified sequence opt3 from neuraminidase__InfluenzaB__AGX15644

SEQ ID NO: 151116 - RNA, 1401 nt, Artificial Sequence; identical to SEQ ID NO: 150977
  derived and/or modified sequence opt3 from neuraminidase__InfluenzaB__AGX15655

SEQ ID NO: 151117 - RNA, 1401 nt, Artificial Sequence; identical to SEQ ID NO: 150977
  derived and/or modified sequence opt3 from neuraminidase__InfluenzaB__AGX15666

SEQ ID NO: 151118 - RNA, 1401 nt, Artificial Sequence; identical to SEQ ID NO: 150977
  derived and/or modified sequence opt3 from neuraminidase__InfluenzaB__AGX15679

SEQ ID NO: 151119 - RNA, 1401 nt, Artificial Sequence
  derived and/or modified sequence opt3 from neuraminidase__InfluenzaB__AGX15690
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggaugaagucuaaaaucggucggugguacucccguacuaugucaaagaccgagcgcauggggaugggccucuaugugaaguacgacggagaccccugggcagauagugacgcucuugccuucagcggcgucaugguguccaugaaagaaccggggugguacucuuuuggauucgagauuaaggauaaaaagugcgacgugccuuguaucgguauagaaaugguccacgauggcgggaaagagacauggcauagcgcugccacugcaauuuauugccugaugggaucaggccaguugcuaugggacaccguuacagguguggauauggcccuguga

SEQ ID NO: 151120 - RNA, 1401 nt, Artificial Sequence; identical to SEQ ID NO: 150977
  derived and/or modified sequence opt3 from neuraminidase__InfluenzaB__AGX15701

SEQ ID NO: 151121 - RNA, 1401 nt, Artificial Sequence
  derived and/or modified sequence opt3 from neuraminidase__InfluenzaB__AGX15712
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaccaaaaggaaauucugcaccccuuauuauccgcgagccuuucauugccugcgggccaaacgaauguaagcauuuugcuuugacacacuacgcagcccagccgggcgguuauuacaaugggacccgaggagaccguaacaaacugagacaucuaaucagcgugaagcucggcaagauacccacggucgaaaauuccaucuuccacauggcugccuggucaggcagugcgugccaugaugggaaagaguggacuuauauuggaguggacgguccugauaacaaugcacugcuuaagguuaaauacggcgaggccuacaccgacacauaucacagcuacgcuaacaagauccugaggacucaggagucugccuguaauugcauugggggaaacuguuauuugaugaucaccgauggcuccgcaucaggugugagcgaaugccgguuucucaaaauacgcgaggggagaauuaucaaggagauuuucccaacaggaagggucaagcacaccgaagaguguacgugcggcuuugcuaguaauaaaacuaucgaaugugccugccgggacaacucuuacacagcgaagcgccccuucgugaaacugaauguagagaccgauacugccgaaauccgauuaaugugcacagacaccuaucuggauacgccuagaccaaacgacggcuccauuaccgggcccugugagagcgauggagacaaggguucgggcgggauaaaaggaggcuuuguucaucaaaggauggagucuaagaucggucggugguacucccguacaaugucaaaaacugaacgcauggggaugggccucuaugugaaguacgacggagauccgugggcagacagugaugcucuugccuucagcggcgucaugguguccaugaaggagccugggugguacucuuuuggauucgaaauuaaagacaagaaaugcgaugugcccuguaucgguauagagaugguccacgacggcgggaaggaaaccuggcauagcgcugccacagcaauuuauugccugaugggaucaggccaguugcuaugggauacuguuaccggugugaacauggcccuguga

SEQ ID NO: 151122 - RNA, 1401 nt, Artificial Sequence; identical to SEQ ID NO: 150977
  derived and/or modified sequence opt3 from neuraminidase__InfluenzaB__AGX15723

SEQ ID NO: 151123 - RNA, 1401 nt, Artificial Sequence; identical to SEQ ID NO: 150977
  derived and/or modified sequence opt3 from neuraminidase__InfluenzaB__AGX15745

SEQ ID NO: 151124 - RNA, 1401 nt, Artificial Sequence; identical to SEQ ID NO: 150977
  derived and/or modified sequence opt3 from neuraminidase__InfluenzaB__AGX15757

SEQ ID NO: 151125 - RNA, 1401 nt, Artificial Sequence
  derived and/or modified sequence opt3 from neuraminidase__InfluenzaB__AGX15768
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccugggcagauagugacgcucuugccuucagcggcgucaugauuuccaugaaggagccggggugguacucuuuuggauucgaaaucaaagauaagaaaugcgacgugccuuguauagguauugagauggugcacgauggcgggaaggaaacauggcauagcgcugccacugcaaucuauugccugaugggaucaggccaguugcuaugggacaccgucacagguguugauauggcccuguga

SEQ ID NO: 151126 - RNA, 1401 nt, Artificial Sequence
  derived and/or modified sequence opt3 from neuraminidase__InfluenzaB__AGX15801
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcguuaacgcaucaaaugugcaagccguaaacagaagcgcgaccaaaggagugacacuccugcugccggaacccgaguggaccuauccuaggcucaguuguccagguuccacuuuccagaaggcuuuacugaucucuccccaccgguuuggcgaaacaaaagggaauagcgccccucuuauuauccgcgagccauucauugcaugcggacccaacgaauguaagcauuuugccuugacccacuacgcugcacagccuggcgguuauuacaaugggacgcgaggagaccguaacaaacugagacaucuaaucuccgucaagcucggcaagauaccaacuguggaaaauucaaucuuccacauggccgcuuggaguggcagcgccugccaugaugggaaagaguggaccuauauuggaguugacgguccggauaacaaugcgcugcuuaaggugaaauacggcgaggcauacacagacacuuaucacucuuacgccaacaagauccugaggacccaggaguccgcuuguaauugcauugggggaaacuguuauuugaugaucacagauggcucagccagcggugucagugaaugccgguuucucaaaauacgcgaggggagaauuaucaaggagauuuuccccaccggaagggugaagcacacggaagaguguacuugcggcuuugcaucuaauaaaacaaucgaaugugcuugccgggacaacuccuacaccgccaagcgcccuuucguaaaacugaauguugagacugauacagcggaaauccgauuaaugugcaccgacacguaucuggauaccccaagacccaacgacggcagcauuacagggccuugugagucgaacggagauaaggguucuggcgggauaaaaggaggcuuugugcaucaaaggauggaguccaagaucggucggugguacucacguacuaugaguaaaaccgaacgcauggggaugggccucuaugucaaguacgacggagacccaugggccgauagcgacgcacuugcuuucuccggcgugauggugucuaugaaggagcccgggugguacagcuuuggauucgaaauuaaagauaagaaaugcgacgucccguguaucgguauagagaugguucacgauggcgggaaggaaacauggcauucagccgcuacugccauuuauugccugaugggaaguggccaguugcuaugggacaccgugacagguguagauauggcacuguga

SEQ ID NO: 151127 - RNA, 1401 nt, Artificial Sequence; identical to SEQ ID NO: 150977
  derived and/or modified sequence opt3 from neuraminidase__InfluenzaB__AGX15812

SEQ ID NO: 151128 - RNA, 1401 nt, Artificial Sequence; identical to SEQ ID NO: 150977
  derived and/or modified sequence opt3 from neuraminidase__InfluenzaB__AGX15823

SEQ ID NO: 151129 - RNA, 1401 nt, Artificial Sequence; identical to SEQ ID NO: 150911
  derived and/or modified sequence opt3 from neuraminidase__InfluenzaB__AGX15845

SEQ ID NO: 151130 - RNA, 1401 nt, Artificial Sequence; identical to SEQ ID NO: 150888
  derived and/or modified sequence opt3 from neuraminidase__InfluenzaB__AGX15856

SEQ ID NO: 151131 - RNA, 1401 nt, Artificial Sequence; identical to SEQ ID NO: 150911
  derived and/or modified sequence opt3 from neuraminidase__InfluenzaB__AGX15867

SEQ ID NO: 151132 - RNA, 1401 nt, Artificial Sequence; identical to SEQ ID NO: 150911
  derived and/or modified sequence opt3 from neuraminidase__InfluenzaB__AGX15889

SEQ ID NO: 151133 - RNA, 1401 nt, Artificial Sequence
  derived and/or modified sequence opt3 from neuraminidase__InfluenzaB__AGX15900
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacaccucgaauguucaagccgugaacagaucagcgacaaaaggaguaaccuuccugcugccggaacccgaguggacuuauccuaggcucagcuguccagguaguacauuucagaaggcuuuacugaucucuccccaccgguucggcgaaaccaaaggaaauuccgccccucuuauuauccgcgagccauuuauugcaugcgggcccaacgaauguaagcauuucgccuugacgcacuacgcugcacagccuggcgguuauuacaaugggacucgaggagaccguaacaaacugagacaucuaaucagcgugaagcucggcaagauaccaaccgucgaaaauuccaucuuucacauggccgcuuggucaggcagugccugccaugaugggaaagaguggacauauauuggaguggacgguccggauaacgacgcgcugcuuaagguuaaauacggcgaggcauacacugauaccuaucacagcuacgccaauaagauccugaggacacaggagucugcuuguaacugcauugggggaaauuguuauuugaugaucaccgacggcuccgccucaggugugagcgaaugccgguuccucaaaauacgcgaggggagaauuaucaaggagauuuuucccacgggaagggucaagcacacugaagaguguacaugcggcuucgcaaguaacaaaaccaucgaaugugcuugccgggauaauucuuacacugccaagcgcccuuuugugaaacugaacguagagacagacaccgcggaaauccgauuaaugugcacggauaccuaucuggacacaccaagacccgaugacggcuccauuacugggccuugugagagcaauggagacaaggguucgggcgggauaaaaggaggcuucguucaucaaaggauggagucuaagaucggucggugguacucccguaccaugucaaaaacagaacgcagagggaugggccucuaugugaaguacgauggagacccaugggccgauagugacgcacuugcuuuuagcggcgucaugguguccaugaaggagcccgggugguacucuuucggauucgaaauuaaagauaagaaaugcgacgugccguguaucgguauagagaugguccacgauggcgggaaggaaacuuggcauagcgccgcuaccgccauuuauugccugaugggaucaggccaguugcuaugggacacaguuaccgguguggauauggcacuguga

SEQ ID NO: 151134 - RNA, 1401 nt, Artificial Sequence; identical to SEQ ID NO: 150911
  derived and/or modified sequence opt3 from neuraminidase__InfluenzaB__AGX15911

SEQ ID NO: 151135 - RNA, 1401 nt, Artificial Sequence
  derived and/or modified sequence opt3 from neuraminidase__InfluenzaB__AGX15933
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaagggucaagcacaccgaagaguguacgugcggcuuugccaguaauaaaacuaucgaaugugcgugccgggacaacucuuacacagccaagcgcccauucgugaaacugaauguagagaccgauacugcagaaauccgauuaaugugcacagacaccuaucuggauacgcccagaccuaacgacggcuccauuaccgggccaugugagagcgauggagacaaggguucgggcgggauaaaaggaggcuuuguucaucaaaggauggagucuaagaucggucggugguacucccguacaaugucaaaaacugaacgcauggggaugggccucuaugugaaguacgacggagaucccugggcugacagugaugcccuugcuuucagcggcgucaugguguccaugaaggagccggggugguacucuuuuggauucgaaauuaaagacaagaaaugcgaugugccuuguaucgguauagagaugguccacgacggcgggaaggaaaccuggcauagcgccgcaacagccauuuauugccugaugggaucaggccaguugcuaugggauacuguuaccgguguggacauggcucuguga

SEQ ID NO: 151136 - RNA, 1401 nt, Artificial Sequence; identical to SEQ ID NO: 150911
  derived and/or modified sequence opt3 from neuraminidase__InfluenzaB__AGX15944

SEQ ID NO: 151137 - RNA, 1401 nt, Artificial Sequence; identical to SEQ ID NO: 150972
  derived and/or modified sequence opt3 from neuraminidase__InfluenzaB__AGX15966

SEQ ID NO: 151138 - RNA, 1401 nt, Artificial Sequence
  derived and/or modified sequence opt3 from neuraminidase__InfluenzaB__AGX15988
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaguucgauuaaugugcaccgacacguaucuggauacccccagaccuaacgacggcuccaucacagggccaugugagagcgauggagacaaggguucgggcgggauuaaaggaggcuuugugcaucaaaggauggagucuaagauaggucggugguacucccguacuaugucaaaaaccgaacgcauggggaugggccucuaugucaaguacgacggagaucccugggcagacagugaugcucuuacauucagcggcgugaugguguccaugaaggagccggggugguacucuuuuggauucgaaaucaaagacaagaaaugcgaugucccuuguauugguaucgagaugguucacgacggcgggaaggaaacuuggcauagcgccgcuaccgccauauauugccugaugggaucaggccaguugcuaugggauacagugaccgguguagacauggcacuguga

SEQ ID NO: 151139 - RNA, 1401 nt, Artificial Sequence; identical to SEQ ID NO: 150972
  derived and/or modified sequence opt3 from neuraminidase__InfluenzaB__AGX15999

SEQ ID NO: 151140 - RNA, 1401 nt, Artificial Sequence; identical to SEQ ID NO: 150972
  derived and/or modified sequence opt3 from neuraminidase__InfluenzaB__AGX16010

SEQ ID NO: 151141 - RNA, 1401 nt, Artificial Sequence; identical to SEQ ID NO: 150972
  derived and/or modified sequence opt3 from neuraminidase__InfluenzaB__AGX16021

SEQ ID NO: 151142 - RNA, 1401 nt, Artificial Sequence
  derived and/or modified sequence opt3 from neuraminidase__InfluenzaB__AGX16032
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcaaggaauggacuuauaucgggguggacggaccggauagcaaugcacugcuuaaaauuaaguacggugaggccuacaccgacacauaucacucuuacgcuaaaaacauccugaggacucaagaauccgccuguaauugcauaggcggggauuguuauuugaugauuaccgacggacccgcaucaggcaucagcgagugccgguuucucaagauucgcgaggguagaaucaucaaggaaauuuucccuacagggaggguuaaacacaccgaggaauguacgugcggauuugcuaguaacaagacuauagagugugccugccgggauaauucuuacacagcgaaacgcccauucgugaagcugaacgucgaaaccgacacugccgagauccgauuaaugugcacagagaccuaucuggauacgcccagaccuaaugacggcuccauuaccggcccaugugaaagcgauggggacaaaggaucggguggcaucaaagggggauuugugcaucagaggauggcaucuaagauaggccggugguacucccguacaaugucaaagacuaagcgcauggguauggggcucuauguaaaauacgacggcgaucccuggaccgacagugaggcucuugcccugagcggaguuaugguguccauggaggaaccgggcugguacucuuucggguuugaaauuaaggauaaaaagugcgacgucccuuguaucggaaucgagauggugcacgaugguggcaaaacaacuuggcauagcgcugccaccgcaauuuauugcuugauggggucaggacagcuacugugggacacagugaccggcgucgauauggcccucuga

SEQ ID NO: 151143 - RNA, 1401 nt, Artificial Sequence; identical to SEQ ID NO: 150759
  derived and/or modified sequence opt3 from neuraminidase__InfluenzaB__AGX16043

SEQ ID NO: 151144 - RNA, 1401 nt, Artificial Sequence; identical to SEQ ID NO: 150761
  derived and/or modified sequence opt3 from neuraminidase__InfluenzaB__AGX16054

SEQ ID NO: 151145 - RNA, 1401 nt, Artificial Sequence
  derived and/or modified sequence opt3 from neuraminidase__InfluenzaB__AGX16087
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcagggaauggacuuauaucgggguggacggaccggauagcaaugcacugcuuaagauuaaauacggugaggccuacaccgacacauaucacucuuacgcuaagaacauccugcggacucaagaauccgccuguaauugcauaggcggggauuguuauuugaugauuaccgacggacccgcaucaggcaucagcgagugccgcuuucucaaaauuagagaggguaggaucaucaaggaaauuuucccuacagggcggguuaagcacaccgaggaauguacgugcggauuugcuaguaacaaaacuauagagugugccugccgcgauaauaacuacacagcgaagcgaccauucgugaaacugaaugucgaaaccgacacugccgagaucagauuaaugugcacagagaccuaucuggauacgcccaggccuaacgacggcucuauuaccggcccaugugaauccaauggggauaagggaagcgguggcaucaaagggggauuugugcaucagcggauggcaucgaagauaggccguugguacucucgcacaauguccaaaacuaagagaauggguauggggcucuauguaaaguacgacggcgaccccuggaccgauucagaggcucuugcccugaguggaguuauggugagcauggaggaaccgggcugguacuccuucggguuugaaauuaaagacaagaaaugcgaugucccuuguaucggaaucgagauggugcacgacgguggcaagacaacuuggcauucugcugccaccgcaauuuauugcuugauggggagcggacagcuacugugggauacagugaccggcgucgacauggcccucuga

SEQ ID NO: 151146 - RNA, 1401 nt, Artificial Sequence
  derived and/or modified sequence opt3 from neuraminidase__InfluenzaB__AGX16109
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaaggaauguaaacauuuugcuuugacccacuacgcagcccagccuggcgguuauuacaacgggacgcgagaggaccguaauaagcugagacaucuaaucagcgugaagcucggaaaaauaccaacugucgagaacuccaucuuccacauggcugccuggucaggcagugcgugccaugauggcagggaauggaccuauguggggguugacggaccggauagcaaugcacugcuuaagauuaaauacggugaggccuacacagacacuuaucacucuuacgcuaagaacauccugcggacccaagaauccgccuguaauugcauuggcggggauuguuauuugaugaucacagacggacccgcaucaggcauaagcgagugccgcuuucucaaaauuagagaggguaggaucauuaaggaaaucuucccuaccgggcgggugaagcacacggaggaauguacuugcggauuugcuaguaacaaaacaaucgagugugccugccgcgauaauucuuacaccgcgaagcgaccauucgucaaacuggacguggaaacugauacagccgagauuagauuaaugugcaccgagacguaucuggacacccccaggccuaacgauggcuccauaacaggcccaugugaagcaaauggggacaagggaagcgguggcaucaaagggggauuuguacaucagcggauggcuucgaagauuggccguugguacucucgcacuauguccaaaaccaagagaauggguauggggcucuauguuaaguacgacggcgaucccuggacagacucagaggcccuugcucugaguggagugauggucagcauggaggaaccgggcugguacuccuucggguuugaaaucaaagauaagaaaugcgacgugccuuguauaggaauugagauggugcacgaugguggcaagacuaccuggcauucugccgcaacagccaucuauugcuugauggggagcggacagcuacugugggacaccgucacuggcguugauauggcucucuga

SEQ ID NO: 151147 - RNA, 1401 nt, Artificial Sequence
  derived and/or modified sequence opt3 from neuraminidase__InfluenzaB__AGX16120
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaaccuuccuccugccggaacccgaguggacuuauccuaggcugagcuguccagguaguacauuucagaaggcccucuuaaucucuccccaccgguucggcgaaaccaaaggaaauuccgcaccucugauuauccgcgagccauuuauugccugcgggcccaaggaauguaaacauuucgcucuuacgcacuacgcagcccagccuggcgguuauuacaacgggacucgagaggaccguaauaaguugagacaucugaucagcgugaagcuaggaaaaauaccaaccgucgagaacuccaucuuucacauggcugccuggucaggcagugcgugccaugauggcaaggaauggacauauauugggguggacggaccggauagcaaugcacuccugaaaaucaaguacggugaggccuacacugacaccuaucacucuuacgcuaacaauauucuuaggacacaggaauccgccuguaacugcaucggcgggaauuguuaucugaugauaaccgauggaucagcaagcggcauuagugagugccgguucuugaaaauccgcgaggguagaauuaucaaggaaaucuuucccacggggaggguuaagcacacugaggaauguacaugcggauucgcuucuaacaaaaccauugagugugccugccgggacaauuccuacacugcgaagcgcccuuuugugaaacucaacgucgaaacagauaccgccgagauacgacugaugugcacggagaccuauuuagacacaccaagacccgaugacggcagcaucacuggcccuugugaaucgaaugggaacaagggaucugguggcauuaaagggggauucgugcaucaaaggauggcauccaagaucggccggugguacucacguaccaugaguaaaacaaagcgcauggguauggggcuguauguaaaguacgauggcgacccauggacugacagcgaugcucucgcccuuuccggaguuauggugucuauggaggaacccggcugguacagcuuuggguucgagauaaaagacaagaaaugcgaugucccguguauuggaaucgaaauggugcacgacgguggcaaggagaccuggcauucagcugccacagcaaucuauugccugauggggaguggacaguugcuaugggauaccgugacuggcgucgacauggcccuguga

SEQ ID NO: 151148 - RNA, 1401 nt, Artificial Sequence; identical to SEQ ID NO: 151147
  derived and/or modified sequence opt3 from neuraminidase__InfluenzaB__AGX16131

SEQ ID NO: 151149 - RNA, 1401 nt, Artificial Sequence; identical to SEQ ID NO: 151147
  derived and/or modified sequence opt3 from neuraminidase__InfluenzaB__AGX16142

SEQ ID NO: 151150 - RNA, 1401 nt, Artificial Sequence
  derived and/or modified sequence opt3 from neuraminidase__InfluenzaB__AGX16153
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaggggaguaacccuccugcugccggaacccgaguggacauauccucggcucagcuguccagguaguaccuuccagaaagccuuacugauuucuccccaccgcuuuggcgaaacuaagggaaauuccgcaccucuuaucauucgagagccauucaucgccugcgggcccaaagaauguaagcauuuugcuuugacacacuacgcagcccagccuggcgguuauuacaacgggacccgugaggacagaaauaaacugaggcaucuaauaagcgugaagcucggaaagaucccaacggucgagaacuccauuuuccacaugacugcuuggucaggcagugccugccaugauggccgggaauggaccuauaucgggguggacggaccggauagcaaugcgcugcuuaaaauuaaguacggugaggcauacacagacacuuaucacucuuacgccaaaaacauccugcgcacccaagaauccgcuuguaauugcauaggcggggauuguuauuugaugauuacagacggacccgccucaggcaucagcgagugcagauuucucaagauuagggagggucggaucaucaaagaaauuuucccuaccgggcgcguuaagcacacggaggaauguacuugcggauuugcaaguaacaagacaauagagugugcuugccgagauaauucuuacaccgccaaaagaccauucgugaagcugaacgucgaaacugacacagcggagaucagguuaaugugcaccgagacguaucuggauacaccccggccuaaugacggcuccauuaccggcccaugugaaagcaacggggauaaaggaucggguggcaucaaagggggauuugugcaucagcguauggccucuaagauaggccgcugguacuccagaacuaugucaaagaccaaaaggauggguauggggcucuauguaaaguacgacggcgaccccuggacagauagugaggcacuugcucugagcggaguuaugguguccauggaggaaccgggcugguacucuuucggguuugaaauuaaggacaaaaagugcgaugucccuuguaucggaaucgagauggugcacgacgguggcaaaacuaccuggcauagcgccgcuacagccauuuauugcuugauggggucaggacagcuacugugggauaccgugacuggcgucgacauggcacucuga

SEQ ID NO: 151151 - RNA, 1401 nt, Artificial Sequence; identical to SEQ ID NO: 151145
  derived and/or modified sequence opt3 from neuraminidase__InfluenzaB__AGX16164

SEQ ID NO: 151152 - RNA, 1401 nt, Artificial Sequence; identical to SEQ ID NO: 150804
  derived and/or modified sequence opt3 from neuraminidase__InfluenzaB__AGX16197

SEQ ID NO: 151153 - RNA, 1401 nt, Artificial Sequence; identical to SEQ ID NO: 150804
  derived and/or modified sequence opt3 from neuraminidase__InfluenzaB__AGX16208

SEQ ID NO: 151154 - RNA, 1401 nt, Artificial Sequence; identical to SEQ ID NO: 150804
  derived and/or modified sequence opt3 from neuraminidase__InfluenzaB__AGX16219

SEQ ID NO: 151155 - RNA, 1401 nt, Artificial Sequence; identical to SEQ ID NO: 150643
  derived and/or modified sequence opt3 from neuraminidase__InfluenzaB__AGX16230

SEQ ID NO: 151156 - RNA, 1401 nt, Artificial Sequence
  derived and/or modified sequence opt3 from neuraminidase__InfluenzaB__AGX16241
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcuacuaaaggaguaacccuccugcugccggaacccgaguggacauauccuagacucagcuguccagguaguaccuuccagaaggccuuacugauuucuccccauagguuuggcgaaacuaaaggaaauuccgcaccucuuaucauucgggagccauucaucgccugcgggcccaaggaauguaaacacuuugcuuugacacauuacgcagcccagccuggcgguuauuacaacgggacccgcgaggaccgaaauaagcugcgucaccuaauaagcgugaagcucggaaaaaucccaacggucgagaacuccauuuuccauauggcugccuggucaggcagugcgugccacgauggcagagaauggacuuauaucgggguggacggaccggauagcaaugcacugcuuaagauuaaauacggugaggccuacaccgacacauaucacucuuacgcuaagaacauccugaggacucaagaauccgccuguaauugcauaggcggggauuguuauuugaugauuaccgacggacccgcaucaggcaucagcgagugccgguuucucaaaauucgcgaggguagaaucaucaaggaaauuuucccuacagggaggguuaagcauaccgaggaauguacgugcggauuugcuaguaacaaaacuauagagugugccugccgggauaauucuuacacagcgaagcgcccauucgugaaacugaacgucgaaaccgacacugccgagauccgauuaaugugcacagagaccuaucuggauacgcccagaccuaaugacggcuccauuaucggcccaugugaaagcaacggggauaagggaucggguggcauaaaagggggauuugugcaccagaggauggcaucuaagauuggccggugguacucccguaccaugucaaaaacaaagcgcauggguauggggcucuauguaaaguacgacggcgaccccuggacugauagugaggcucuuacccugagcggaguuaugguguccauggaggaaccgggcugguacucuuucggguuugaaaucaaagacaagaaaugcgaugucccuuguaucggaauugagauggugcaugacgguggcaagacaacuuggcacagcgccgcuaccgccaucuauugcuugauggggucaggacagcuacugugggauacagugaccggcgucgacauggcacucuga

SEQ ID NO: 151157 - RNA, 1401 nt, Artificial Sequence
  derived and/or modified sequence opt3 from neuraminidase__InfluenzaB__AGX16252
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgagugggcauauccuaggcucagcuguccagguaguaccuuccagaaggccuuacugauuucuccccaccgguuuggcgaaacaaaaggaaauuccgcuccucuuaucauucgcgagccauucaucgcaugcgggcccaccgaauguaagcauuuugccuugacucacuacgcugcccagccuggcgguuauuacaacgggacacgagaggaccguaauaaacugagacaucuaauaagcgugaagcucggaaagaucccaaccgucgagaacuccauuuuccacauggcggcauggucaggcagugccugccaugauggcaaagaauggacguauaucgggguggacggaccggauagcaaugcucugcuuaagauuaaauacggugaggccuacacugacaccuaucacucuuacgcaaagaacauccugaggacacaagaauccgcuuguaauugcauaggcggggauuguuauuugaugauuacugacggacccgccucaggcaucagcgagugccgguuucucaaaauucgcgaggguagaaucaucaaggaaauuuucccuaccgggaggguuaagcacacagaggaauguaccugcggauuugcgaguaacaaaacgauagagugugccugccgggauaaucgcuacacugcaaagcgaccauucgugaaacugaacgucgaaacagacaccgcugagaucagauuaaugugcacugagacauaucuggauacccccaggccuaaugacggcucuauuacgggcccaugugaauccgauggggacaagggaagcgguggcaucaaagggggauuugugcaucagcggauggccucgaagauaggccguugguacucucgcaccauguccaaaacaaagagaauggguauggggcucuauguaaaguacgacggcgaucccuggacugacucagaggcucuugcccugaguggaguuauggugagcauggaggaaccgggcugguacuccuucggguuugaaauuaaagauaagaaaugcgacgucccuuguaucggaaucgagauggugcacgaugguggcaagaccacauggcauucugcagccacugcuauuuauugcuugauggggagcggacagcuacugugggacaccgugacaggcgucgauauggcgcucuga

SEQ ID NO: 151158 - RNA, 1401 nt, Artificial Sequence; identical to SEQ ID NO: 150804
  derived and/or modified sequence opt3 from neuraminidase__InfluenzaB__AGX16274

SEQ ID NO: 151159 - RNA, 1401 nt, Artificial Sequence
  derived and/or modified sequence opt3 from neuraminidase__InfluenzaB__AGX16285
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccaccacaggcccaugugaaagcgauggggacaagggaucggguggcauuaaagggggauuugugcaucagaggauggcuucuaagaucggccggugguacucccguacuaugucaaaaaccaagcgcauggguauggggcucuauguaaaguacgacggcgaucccuggacagacagugaggcccuugcucugagcggaguuaugguguccauggaggaaccgggcugguacucuuucggguuugaaauaaaagauaagaaaugcgacgucccuuguauuggaaucgagauggugcacgaugguggcaagacuaccuggcauagcgccgcaacagccaucuauugcuugauggggucaggacagcuacugugggacaccgugacuggcgucgauauggcucucuga

SEQ ID NO: 151160 - RNA, 1401 nt, Artificial Sequence; identical to SEQ ID NO: 150804
  derived and/or modified sequence opt3 from neuraminidase__InfluenzaB__AGX16296

SEQ ID NO: 151161 - RNA, 1401 nt, Artificial Sequence; identical to SEQ ID NO: 150651
  derived and/or modified sequence opt3 from neuraminidase__InfluenzaB__AGX16307

SEQ ID NO: 151162 - RNA, 1401 nt, Artificial Sequence; identical to SEQ ID NO: 150804
  derived and/or modified sequence opt3 from neuraminidase__InfluenzaB__AGX16329

SEQ ID NO: 151163 - RNA, 1401 nt, Artificial Sequence
  derived and/or modified sequence opt3 from neuraminidase__InfluenzaB__AGX16362
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcguuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaaaaacuaagcgcauggguauggggcucuauguuaaguacgacggcgaucccuggaccgacagugaggcccuugcucugagcggagugauggucuccauggaggaaccgggcugguacucuuucggguuugaaauaaaagauaagaaaugcgacgugccuuguauuggaaucgagauggugcacgaugguggcaagacaacuuggcauagcgccgcaaccgccaucuauugcuugauggggucaggacagcuacugugggacacagucaccggcguugauauggcucucuga

SEQ ID NO: 151164 - RNA, 1401 nt, Artificial Sequence; identical to SEQ ID NO: 150976
  derived and/or modified sequence opt3 from neuraminidase__InfluenzaB__AGX16373

SEQ ID NO: 151165 - RNA, 1401 nt, Artificial Sequence
  derived and/or modified sequence opt3 from neuraminidase__InfluenzaB__AGX16384
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggcaauuccgccccucuuaucauucgcgagccauucaucgcuugcggacccacugaauguaagcauuuugcauugacacacuacgccgcucagccuggcgguuauuacaacgggacccgagaggaccguaauaaacugaagcaucuaauaagcgugaagcucggaaaaaucccaacggucgagaacuccauuuuccacauggccgcguggucaggcagugcaugccaugauggcaaggaauggacuuauaucgggguggacggaccggauagcaaugcccugcuuaaaauuaaguacggugaggcuuacaccgacacauaucacucuuacgccaaaaacauccugagaacucaagaauccgcauguaauugcauaggcggggauuguuauuugaugauuaccgacggacccgcuucaggcaucagcgagugcagguuucucaagauucgggagggucgcaucaucaaggaaauuuucccuacagggagaguuaaacacaccgaggaauguacgugcggauuugccaguaacaagacuauagagugugcgugcagggauaauucuuacacagccaaacggccauucgugaagcugaacgucgaaaccgacacugcagagauccgcuuaaugugcacagagaccuaucuggauacgccccgaccuaaugacggcuccauuaccggcccaugugaaagcgauggggacaaaggaucggguggcaucaaagggggauuugugcaucagagaauggcuucuaagauagggaggugguacucccggacaaugucaaagacuaagcguauggguauggggcucuauguaaaauacgacggcgaucccuggaccgacagugaggcccuugcucugagcggaguuaugguguccauggaggaaccgggcugguacucuuucggguuugaaauuaaggauaaaaagugcgacgucccuuguaucggaaucgagauggugcacgaugguggcaaaacaacuuggcauagcgccgcaaccgccauuuauugcuugauggggucaggacagcuacugugggacacagugaccggcgucgauauggcucucuga

SEQ ID NO: 151166 - RNA, 1401 nt, Artificial Sequence; identical to SEQ ID NO: 150833
  derived and/or modified sequence opt3 from neuraminidase__InfluenzaB__AGX16406

SEQ ID NO: 151167 - RNA, 1401 nt, Artificial Sequence; identical to SEQ ID NO: 150833
  derived and/or modified sequence opt3 from neuraminidase__InfluenzaB__AGX16427

SEQ ID NO: 151168 - RNA, 1401 nt, Artificial Sequence; identical to SEQ ID NO: 150833
  derived and/or modified sequence opt3 from neuraminidase__InfluenzaB__AGX16438

SEQ ID NO: 151169 - RNA, 1401 nt, Artificial Sequence; identical to SEQ ID NO: 150833
  derived and/or modified sequence opt3 from neuraminidase__InfluenzaB__AGX16449

SEQ ID NO: 151170 - RNA, 1401 nt, Artificial Sequence; identical to SEQ ID NO: 150833
  derived and/or modified sequence opt3 from neuraminidase__InfluenzaB__AGX16460

SEQ ID NO: 151171 - RNA, 1401 nt, Artificial Sequence
  derived and/or modified sequence opt3 from neuraminidase__InfluenzaB__AGX16471
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacaaagaccuaucuggauacgcccagaccuaaugacggcuccauuaccggcccaugugagagcgauggggacaaaggaucggguggcaucaaagggggauuugugcaucagaggauggcuucuaagauaggccggugguacucccguacaaugucaaagacucgcagaauggguauggggcucuauguaaaguacgacggcgaucccuggaccgacagugaagcccuugcucugagcggaguuaugguguccauggaggaaccgggcugguacucuuucggguuugagauuaaagauaagaaaugcgacgucccuuguaucggaaucgaaauggugcacgaugguggcaagacaacuuggcauagcgccgcaaccgccauuuauugcuugauggggucaggacagcuacugugggacacagugaccggcgucgauauggcucucuga

SEQ ID NO: 151172 - RNA, 1401 nt, Artificial Sequence; identical to SEQ ID NO: 150833
  derived and/or modified sequence opt3 from neuraminidase__InfluenzaB__AGX16482

SEQ ID NO: 151173 - RNA, 1401 nt, Artificial Sequence
  derived and/or modified sequence opt3 from neuraminidase__InfluenzaB__AGX16493
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuguggucuccauggaggaaccgggcugguacucuuucggguuugaaauuaaagauaagaaaugcgacgugccuuguaucggaaucgagauggugcacgaugguggcaagacaacuuggcauagcgccgcaaccgccauuuauugcuugauggggucaggacagcuacugugggacacagucaccggcguugauauggcucucuga

SEQ ID NO: 151174 - RNA, 1401 nt, Artificial Sequence; identical to SEQ ID NO: 150632
  derived and/or modified sequence opt3 from neuraminidase__InfluenzaB__AGX16504

SEQ ID NO: 151175 - RNA, 1401 nt, Artificial Sequence; identical to SEQ ID NO: 150632
  derived and/or modified sequence opt3 from neuraminidase__InfluenzaB__AGX16515

SEQ ID NO: 151176 - RNA, 1401 nt, Artificial Sequence
  derived and/or modified sequence opt3 from neuraminidase__InfluenzaB__AGX16548
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaacgguucgggcgggauuaagggaggcuuugugcaucaaaggauggcaucuaaaaucggucggugguacucccguacuaugucaaagaccaaacgcauggggaugggccucuauguaaaguacgacggagaccccugggcugauagugacgcccuugcucugagcggcguuaugguguccauggaggaaccggggugguacucuuucggauuugaaauaaaggauaaaaagugcgacgucccuuguauugguaucgagauggugcacgauggcgggaaagaaacauggcauagcgccgcaacugccaucuauugcuugaugggaucaggccagcuacugugggacaccgugacaggugucgauauggcucucuga

SEQ ID NO: 151177 - RNA, 1401 nt, Artificial Sequence
  derived and/or modified sequence opt3 from neuraminidase__InfluenzaB__AGX16559
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucaagcggugaacagaucagcuacuaaaggaguaacccuccugcugcccgaaccugaguggacauauccaaggcucagcugucccgguaguaccuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguaucagcgaaugccgguuucucaaaauucgcgaggggagaaucaucaaggagauuuucccuacaggaaggguuaagcacaccgaagaguguacgugcggcuuugcuaguaauaaaacuauagaaugugccugccgggacaacucuuacacagcgaagcgcccauucgugaaacugaaugucgagaccgauacugccgaaauccgauuaaugugcacagagaccuaucuggacacgcccagaccugaugacggcuccauuaccgggccaugugagagcaacggagauaaggguucgggcgggaucaaaggaggcuuugugcaucaaaggauggcaucuaagauaggucggugguacucccguacaaugucaaaaacuaagcgcauggggaugggccucuauguaaaguacgacggagaccccugggcugauagugacgcccuugcucugagcggcguuaugguguccauggaggaaccggggugguacucuuucggauuugaaauuagagauaaaaagugcgacgucccuuguaucgguaucgagauggugcacgauggcgggaaagaaaccuggcauagcgccgcaacagccauuuauugcuugaugggaucaggccagcuacugugggacacugugaccggugucgauauggcucucuga

SEQ ID NO: 151178 - RNA, 1401 nt, Artificial Sequence
  derived and/or modified sequence opt3 from neuraminidase__InfluenzaB__AGX16581
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucaagcggugaacagaucagcuacuaaaggaguaacccuccugcugcccgaaccugaguggacauauccaaggcucagcugucccgguaguaccuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguaucagcgaaugccgguuucucaaaauucgcgaggggagaaucaucaaggagauuuucccuacaggaaggguuaagcacaccgaagaguguacgugcggcuuugcuaguaauaaaacuauagaaugugccugccgggacaacucuuacacagcgaagcgcccauucgugaaacugaaugucgagaccgauacugccgaaauccgauuaaugugcacagagaccuaucuggacacgcccagaccugaugacggcuccauuaccgggccaugugagagcaacggagauaaggguucgggcgggaucaaaggaggcuuugugcaucaaaggauggcaucuaagauaggucggugguacucccguacaaugucaaaaacuaagcgcauggggaugggccucuauguaaaguacgacggagaccccugggcugauagugacgcccuugcucugagcggcguuaugguguccauggaggaaccggggugguacucuuucggauuugaaauuaaagauaagaaaugcgacgucccuuguaucgguaucgagauggugcacgauggcgggaaggaaaccuggcauagcgccgcaacagccauuuauugcuugaugggaucaggccagcuacugugggacacugugaccggugucgauauggcucucuga

SEQ ID NO: 151179 - RNA, 1401 nt, Artificial Sequence; identical to SEQ ID NO: 151178
  derived and/or modified sequence opt3 from neuraminidase__InfluenzaB__AGX16592

SEQ ID NO: 151180 - RNA, 1401 nt, Artificial Sequence; identical to SEQ ID NO: 150632
  derived and/or modified sequence opt3 from neuraminidase__InfluenzaB__AGX16603

SEQ ID NO: 151181 - RNA, 1401 nt, Artificial Sequence; identical to SEQ ID NO: 150698
  derived and/or modified sequence opt3 from neuraminidase__InfluenzaB__AGX16614

SEQ ID NO: 151182 - RNA, 1401 nt, Artificial Sequence; identical to SEQ ID NO: 151176
  derived and/or modified sequence opt3 from neuraminidase__InfluenzaB__AGX16625

SEQ ID NO: 151183 - RNA, 1401 nt, Artificial Sequence
  derived and/or modified sequence opt3 from neuraminidase__InfluenzaB__AGX16636
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucaagcggugaacagaucagcuacuaaaggaguaacccuccugcugcccgaaccugaguggacauauccaaggcucagcugucccgguaguaccuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguaucagcgaaugccgguuucucaaaauucgcgaggggagaaucaucaaggagauuuucccuacaggaaggguuaagcacaccgaagaguguacgugcggcuuugcuaguaauaaaacuauagaaugugccugccgggacaacucuuacacagcgaagcgcccauucgugaaacugaaugucgagaccgauacugccgaaauccgauuaaugugcacagagaccuaucuggacacgcccagaccugaugacggcuccauuaccgggccaugugagagcaacggagauaaggguucgggcgggaucaaaggaggcuuugugcaucaaaggauggcaucuaagauaggucggugguacucccguacaaugucaaaaacuaagcgcauggggaugggccucuauguaaaguacgacggagaccccugggcugauagugacgcccuugcucugagcggcguuaugguguccauggaggaaccggggugguacucuuucggauuugaaauuaaagauaagaaaugcgacgucccuuguaucgguaucgagauggugcacgauggcgggaaggaaaccuggcauagcgccgcaacagccauuuauugcuugaugggaucaggccagcuacuguggaacacugugaccggugucgacauggcucucuga

SEQ ID NO: 151184 - RNA, 1401 nt, Artificial Sequence; identical to SEQ ID NO: 150630
  derived and/or modified sequence opt3 from neuraminidase__InfluenzaB__AGX16647

SEQ ID NO: 151185 - RNA, 1401 nt, Artificial Sequence; identical to SEQ ID NO: 151178
  derived and/or modified sequence opt3 from neuraminidase__InfluenzaB__AGX16658

SEQ ID NO: 151186 - RNA, 1401 nt, Artificial Sequence; identical to SEQ ID NO: 150632
  derived and/or modified sequence opt3 from neuraminidase__InfluenzaB__AGX16669

SEQ ID NO: 151187 - RNA, 1401 nt, Artificial Sequence; identical to SEQ ID NO: 150698
  derived and/or modified sequence opt3 from neuraminidase__InfluenzaB__AGX16680

SEQ ID NO: 151188 - RNA, 1401 nt, Artificial Sequence; identical to SEQ ID NO: 150632
  derived and/or modified sequence opt3 from neuraminidase__InfluenzaB__AGX16691

SEQ ID NO: 151189 - RNA, 1401 nt, Artificial Sequence
  derived and/or modified sequence opt3 from neuraminidase__InfluenzaB__AGX16702
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggaagcgaggagaccguaauaagcugagacaucuaaucagcgugaaacucggcaagauaccgacggucgagaacuccaucuuccacauggcugccuggucaggcagugcgugccaugaugggaaagaguggacuuauauuggaguggacggucccgauaauaacgcacugcuuaagaucaaauacggcgaagccuacaccgacacauaucacagcuacgcuaauaacauucugaggacucaggagucugccuguaauugcaucgggggaaacuguuauuugaugauaaccgauggcuccgcaucagguauuagcgaaugccgguuucucaagauccgcgaggggagaauuaucaaggagaucuucccuacaggaaggguuaaacacaccgaagaguguacgugcggcuuugcuaguaauaagacuauugaaugugccugccgggacaacucuuacacagcgaaacgcccauucgugaagcugaaugucgagaccgauacugccgaaauacgauuaaugugcacagagaccuaucuggacacgcccagaccugaugacggcuccaucaccgggccaugugagagcaacggagauaaagguucgggcgggauuaagggaggcuuugugcaucaaaggauggcaucuaaaaucggucggugguacucccguacaaugucaaagacuaagcgcauggggaugggccucuauguaaaauacgacggagaccccugggcugauagugacgcccuugcucugagcggcguuaugguguccauggaggaaccggggugguacucuuucggauuugaaauaaaggauaaaaagugcgacgucccuuguauugguaucgagauggugcacgauggcgggaaagaaaccuggcauagcgccgcaacagccaucuauugcuugaugggaucaggccagcuacugugggacacugugaccggugucgauauggcucucuga

SEQ ID NO: 151190 - RNA, 1401 nt, Artificial Sequence
  derived and/or modified sequence opt3 from neuraminidase__InfluenzaB__AGX16713
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguaucuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguaucagcgaaugccgguuucucaaaauucgcgaggggagaaucaucaaggagauuuucccuacaggaaggguuaagcacaccgaagaguguacgugcggcuuugcuaguaauaaaacuauagaaugugccugccgggacaacucuuacacagcgaagcgcccauucgugaaacugaaugucgagaccgauacugccgaaauccgauuaaugugcacagagaccuaucuggacacgcccagaccugaugacggcuccauuaccgggccaugugagagcaacggagauaaggguucgggcgggaucaaaggaggcuuugugcaucaaaggauggcaucuaagauaggucggugguacucccguacaaugucaaaaacuaagcgcauggggaugggccucuauguaaaguacgacggagaccccugggcugauagugacgcccuugcucugagcggcguuaugguguccauggaggaaccggggugguacucuuucggauuugaaauuagagauaaaaagugcgacgucccuuguaucgguaucgagauggugcacgauggcgggaaagaaaccuggcauagcgccgcaacagccauuuauugcuugaugggaucaggccagcuacugugggacacugugaccggugucgauauggcucucuga

SEQ ID NO: 151191 - RNA, 1401 nt, Artificial Sequence; identical to SEQ ID NO: 150632
  derived and/or modified sequence opt3 from neuraminidase__InfluenzaB__AGX16724

SEQ ID NO: 151192 - RNA, 1401 nt, Artificial Sequence; identical to SEQ ID NO: 151178
  derived and/or modified sequence opt3 from neuraminidase__InfluenzaB__AGX16735

SEQ ID NO: 151193 - RNA, 1401 nt, Artificial Sequence; identical to SEQ ID NO: 151178
  derived and/or modified sequence opt3 from neuraminidase__InfluenzaB__AGX16746

SEQ ID NO: 151194 - RNA, 1401 nt, Artificial Sequence; identical to SEQ ID NO: 150632
  derived and/or modified sequence opt3 from neuraminidase__InfluenzaB__AGX16757

SEQ ID NO: 151195 - RNA, 1401 nt, Artificial Sequence
  derived and/or modified sequence opt3 from neuraminidase__InfluenzaB__AGX16768
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucaagcggugaacagaucagcuacuaaaggaguaacccuccugcugcccgaaccugaguggacauauccaaggcucagcugucccgguaguaccuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguaucagcgaaugccgguuucucaaaauucgcgaggggagaaucaucaaggagauuuucccuacaggaaggguuaagcacaccgaagaguguacgugcggcuuugcuaguaauaaaacuauagaaugugccugccgggacaacucuuacacagcgaagcgcccauucgugaaacugaaugucgagaccgauacugccgaaauccgauuaaugugcacagagaccuaucuggacacgcccagaccugaugacggcuccauuaccgggccauguaagagcaacggagauaaagguucgggcgggaucaagggaggcuuugugcaucaaaggauggcaucuaaaauaggucggugguacucccguacaaugucaaagacuaagcgcauggggaugggccucuauguaaaauacgacggagaccccugggcugauagugacgcccuugcucugagcggcguuaugguguccauggaggaaccggggugguacucuuucggauuugagauuaaggauaaaaagugcgacgucccuuguaucgguaucgaaauggugcacgauggcgggaaagagaccuggcauagcgccgcaacagccauuuauugcuugaugggaucaggccagcuacugugggacacugugaccggugucgauauggcucucuga

SEQ ID NO: 151196 - RNA, 1401 nt, Artificial Sequence; identical to SEQ ID NO: 150698
  derived and/or modified sequence opt3 from neuraminidase__InfluenzaB__AGX16779

SEQ ID NO: 151197 - RNA, 1401 nt, Artificial Sequence
  derived and/or modified sequence opt3 from neuraminidase__InfluenzaB__AGX16790
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggaggccguaauaagcugagacaucuaaucagcgugaagcucggcaaaauaccgacugucgagaacuccaucuuccacauggcugccuggucagggagugcgugccaugacggaaaggaguggaccuauauugguguggauggccccgacaauaacgcacugcuuaaaaucaaguacggggaagccuacacagauacuuaucacagcuacgcuaauaacauucugaggacccaggagucugccuguaauugcaucggaggcaacuguuauuugaugauaacagacgguuccgcaucagggauuagcgaaugccgguuucucaaaauccgcgagggaagaauuaucaaggagaucuucccuaccggcaggguuaagcacacggaagaguguacuugcggcuuugcuaguaauaaaacaauugaaugugccugccgggauaacucuuacaccgcgaagcgcccauucgugaaacugaaugucgagacugacacagccgaaauacgauuaaugugcaccgagacguaucuggauacccccagaccugacgauggguccaucacaggaccaugugagagcaacggugacaagggcucugggggaauuaaaggcgguuuugugcaucaaaggauggcaucgaagaucgggcggugguacucccguacuaugucaaaaaccaagcgcaugggcaugggacucuauguaaaguacgauggcgaccccugggcugacagugaugcccuugcucugagcgggguuaugguguccauggaggaaccgggaugguacucuuucgguuuugaaauaagagacaaaaagugcgaugucccuuguauuggcaucgagauggugcacgacgggggaaaagaaacauggcauagcgccgcaacugccaucuauugcuugaugggcucaggucagcuacugugggauaccgugacaggggucgacauggcucucuga

SEQ ID NO: 151198 - RNA, 1401 nt, Artificial Sequence
  derived and/or modified sequence opt3 from neuraminidase__InfluenzaB__AGX16801
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucaagcggugaacagaucagcuacuaaaggaguaacccuccugcugcccgaaccugaguggacauauccaaggcucagcugucccgguaguaccuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguaucagcgaaugccgguuucucaaaauucgcgaggggagaaucaucaaggagauuuucccuacaggaaggguuaagcacaccgaagaguguacgugcggcuuugcuaguaauaaaacuauagaaugugccugccgggacaacucuuacacagcgaagcgcccauucgugaaacugaaugucgagaccgauacugccgaaauccgauuaaugugcacagagaccuaucuggacacgcccagaccuaacgauggcuccauuaccgggccaugugagagcaacggagacaaggguucgggcgggaucaaaggaggcuuugugcaucaaaggauggcaucuaagauaggucggugguacucccguacaaugucaaaaacuaagcgcauggggaugggccucuauguaaaguacgauggagaccccugggcugacagugaugcccuugcucugagcggcguuaugguguccauggaggaaccggggugguacucuuucggauuugaaauuaaagacaagaaaugcgaugucccuuguaucgguaucgagauggugcacgacggcgggaaggaaaccuggcauagcgccgcaacagccauuuauugcuugaugggaucaggccagcuacugugggauacugugaccggugucgacauggcucucuga

SEQ ID NO: 151199 - RNA, 1401 nt, Artificial Sequence; identical to SEQ ID NO: 150632
  derived and/or modified sequence opt3 from neuraminidase__InfluenzaB__AGX16812

SEQ ID NO: 151200 - RNA, 1401 nt, Artificial Sequence
  derived and/or modified sequence opt3 from neuraminidase__InfluenzaB__AGX16823
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugcagauggcuccaucacagggccaugugagagcaacggagacaaggguucgggcgggauuaaaggaggcuuugugcaucaaaggauggcuucuaagaucggucggugguacucccguacuaugucaaaaaccaagcgcauggggaugggccucuauguaaaguacgauggagaccccugggccgacagugaugcucuugcccugagcggcguuaugguguccauggaggaaccggggugguacucuuucggauuugaaauaaaagacaagaaaugcgaugucccuuguauugguaucgagauggugcacgacggcgggaaggaaacauggcauagcgcagccacugcuaucuauugcuugaugggaucaggccagcuacugugggauaccgugacaggugucgacauggcgcucuga

SEQ ID NO: 151201 - RNA, 1401 nt, Artificial Sequence; identical to SEQ ID NO: 150632
  derived and/or modified sequence opt3 from neuraminidase__InfluenzaB__AGX16834

SEQ ID NO: 151202 - RNA, 1401 nt, Artificial Sequence
  derived and/or modified sequence opt3 from neuraminidase__InfluenzaB__AGX16845
augcugcccagcaccauccagacacucacucuuuuccugacguccggcgggguguuguuaucucuguacgucucagccagucuaagcuaucuccuguacuccgacauucuucugaaguuuucuccuaccgagauaacaacuccaaccaugccguuggauugcgcuaacgcaucgaauguucaagccgugaacagaucagcgacaaaaggaguaacccuccugcugcccgaaccugaguggacuuauccaaggcucagcugucccgguaguacauuccagaaggcuuuacugguguccccucaccgguuuggcgaaaccaaaggaaauucugccccacuuaucauucgcgagcccuucaucgcaugcgggccuaaggaauguaaacauuuugccuugacgcacuacgcugcacagccaggcgguuauuacaacgggacucgaggagaccguaauaagcugagacaucuaauuagcgucaagcucggcaaaaucccgaccguggagaacuccauauuccacauggccgcuuggucaggcagugccugccaugaugggaaggaguggacauauaucggaguugacggucccgauaauaacgcgcugcuuaaaauuaaguacggcgaagcauacacugacaccuaucacagcuacgccaauaacauccugaggacacaggagucugcuuguaauugcauugggggaaacuguuauuugaugaucaccgauggcuccgccucagguauaagcgaaugccgguuucucaaaauucgcgaggggagaaucauuaaggagaucuucccuacgggaagggugaagcacacugaagaguguacaugcggcuuugcaaguaauaaaaccaucgaaugugcuugccgggacaacucuuacacugccaagcgcccauucgucaaacugaauguggagacagauaccgcggaaauucgauuaaugugcacggagaccuaucuggacacacccagaccugaugacggcuccauaacugggccaugugagagcaacggagauaaggguucgggcgggaucaaaggaggcuuuguacaucaaaggauggccucuaagauuggucggugguacucccguaccaugucaaaaacaaagcgcauggggaugggccucuauguuaaguacgacggagaccccugggcagauagugacgcucuugcccugagcggcgugauggucuccauggaggaaccggggugguacucuuucggauuugaaaucaaagauaagaaaugcgacgugccuuguauagguauugagauggugcacgauggcgggaaggaaacuuggcauagcgcugccaccgcaaucuauugcuugaugggaucaggccagcuacugugggacacagucaccgguguugauauggcccucuga

SEQ ID NO: 151203 - RNA, 1401 nt, Artificial Sequence
  derived and/or modified sequence opt3 from neuraminidase__InfluenzaB__AGX16856
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuguuccguuggauugcgcaaacgccucgaaugugcaagcgguaaacagaucagcuaccaaaggagugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacagcgggacgcgaggagaccguaacaagcugagacaucuaaucuccgucaagcucggcaaaauaccgacuguggaaaauucaaucuuccacauggcugccuggaguggcagcgcgugccaugaugggaaggaguggaccuauauuggaguugacggucccgauaacaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaagggugaagcacacggaagaguguacuugcggcuuugcuucuaacaaaacaauugaaugugccugccgggacaauuccuacaccgcgaagcgcccauucgucaaacugaacguggagacugauacagccgaaauacgauuaaugugcaccgagacguaucuggacacccccagaccugaugacggcagcaucacagggccaugugagucgaauggagauaaggguucuggcgggauuaaaggaggcuuuguacaucaaaggauggcauccaagaucggucggugguacucacguacuaugaguaaaaacaagcgcauggggaugggccucuauguuaaguacgacggagaccccugggcugauagcgacgcccuugcucuguccggcgugauggucucuauggaggagccggggugguacagcuucggauuugaaauaaaagauaagaaaugcgacgugccuuguauugguaucgagauggugcacgauggcgggaaggaaaccuggcauucagccgcaacagccaucuauugcuugaugggaaguggccagcuacugugggacacugucaccgguguugauauggcucucuga

SEQ ID NO: 151204 - RNA, 1401 nt, Artificial Sequence; identical to SEQ ID NO: 150632
  derived and/or modified sequence opt3 from neuraminidase__InfluenzaB__AGX16867

SEQ ID NO: 151205 - RNA, 1401 nt, Artificial Sequence
  derived and/or modified sequence opt3 from neuraminidase__InfluenzaB__AGX16878
augcugcccagcaccauccagacacucacucuuuuccugacguccggcgggguguuguuaucucuguacgucucagccagucuaagcuaucuccuguacuccgacauucuucugaaguuuucuccuaccgaguugacagcuccaacuaugccgcucgauugcgcaaacgccucgaauguucaagcggugaacagaucagcuaccaaaggaguaacacugcugcuccccgaaccugaguggaccuauccaagguuaagcugucccgguaguacuuuccagaaggcccugcuuauauccccucaccgguuuggcgaaacaaaaggaaauucugcaccauugaucauucgcgagcccuucaucgccugcgggccuaaggaauguaaacauuuugcucugacccacuacgcagcccagccaggcgguuauuacaacgggaagcgaggagaccguaauaagcuaagacaucucauuagcgugaaacugggcaagaucccgacggucgagaacuccauauuccacauggcugccuggucaggcagugcgugccaugaugggaaagaguggacuuauaucggaguggacggucccgauaauaacgcacuucugaagauuaaauacggcgaagccuacaccgacacauaucacagcuacgcuaauaacaucuugaggacucaggagucugccuguaauugcauugggggaaacuguuaucucaugaucaccgauggcuccgcaucagguauaagcgaaugccgguuucugaagauucgcgaggggagaaucauuaaggagaucuucccuacaggaaggguuaaacacaccgaagaguguacgugcggcuuugcuaguaauaagacuaucgaaugugccugccgggacaacucuuacacagcgaaacgcccauucgugaaguuaaaugucgagaccgauacugccgaaauucgacugaugugcacagagaccuaucucgacacgcccagaccugaugacggcuccauaaccgggccaugugagagcaacggagauaacgguucgggcgggaucaaaggaggcuuugugcaucaaaggauggcaucuaagauuggucggugguacucccguacaaugucaaaaacuaagcgcauggggaugggccuuuauguaaaguacgacggagaccccugggcugauagugacgcccuggcuuugagcggcguuaugguguccauggaggaaccggggugguacucuuucggauuugaaaucaaagauaagaaaugcgacgucccuuguauagguauugagauggugcacgauggcgggaaggaaaccuggcauagcgccgcaacagccaucuauugccuaaugggaucaggccagcugcucugggacacugugaccggugucgauauggcucuguga

SEQ ID NO: 151206 - RNA, 1401 nt, Artificial Sequence; identical to SEQ ID NO: 151178
  derived and/or modified sequence opt3 from neuraminidase__InfluenzaB__AGX16889

SEQ ID NO: 151207 - RNA, 1401 nt, Artificial Sequence
  derived and/or modified sequence opt3 from neuraminidase__InfluenzaB__AGX16900
augcugcccagcaccauccagacacucacucuuuuccugacgaccggcgggguguuguuaucccuguacgucucugccucacuaaguuaucuccuguacagcgacauucuucugaaguuuuccccuacagagauaaucgcuccaacuaugccguuggauugcgcaaacgccucuaauguucaagcggugaacagaucggcuaccaaaggaguaacacuccugcugcccgaaccugaguggaccuauccaaggcucucaugucccgguagcacuuuccagaaggccuuacugauuaguccucaccgguuuggcgaaacaaaaggaaauuccgcaccacuuaucauucgcgagcccuucaucgccugcgggccuaaggaauguaaacauuuugcuuugacccacuacgcagcccagccaggcgguuauuacaacgggacgcgaggagaccguaauaagcugagacaucuaauaucugugaagcucggcaaaaucccgacugucgagaacagcauuuuccacauggcugccugguccggcucagcgugccaugaugggaaggaguggaccuauaucggaguggacggucccgauaauaacgcacugcuuaaaauuaaguacggcgaagccuacacagacacuuaucacaguuacgcuaauaacauccugaggacccaggagagcgccuguaauugcauagggggaaacuguuauuugaugauuacagauggcucugcauccgguaucucagaaugccgguuucucaaaauucgcgaggggagaaucaucaaggagauuuucccuaccggaaggguuaagcacacggaagaguguacuugcggcuuugcuagcaauaaaacaauagaaugugccugccgggacaacaguuacaccgcgaagcgcccauucgugaaacugaaugucgagacugauacagccgaaauccgauuaaugugcaccgagacguaucuggacacccccagaccugaugacggcucuauuacagggccaugugaguccaacggagauaaggguagcggcgggaucaaaggaggcuuugugcaucaaaggauggcaucgaagauaggucggugguacucucguacuauguccaaaaccaagcgcauggggaugggccucuauguaaaguacgacggagaccccugggcugauucagacgcccuugcucugaguggcguuauggugagcauggaggaaccggggugguacuccuucggauuugaaauuaaagauaagaaaugcgacgucccuuguaucgguaucgagauggugcacgauggcgggaaggaaacauggcauucugccgcaacugccauuuauugcuugaugggaagcggccagcuacugugggacaccgugacaggugucgauauggcucucuga

SEQ ID NO: 151208 - RNA, 1401 nt, Artificial Sequence
  derived and/or modified sequence opt3 from neuraminidase__InfluenzaB__AGX16911
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugccgcucgauugcgcaaacgccucuaauguucaagcggugaacagaucggcuaccaaaggaguaacacugcugcuccccgaaccugaguggaccuauccaagguuaucaugucccgguagcacuuuccagaaggcccugcuuaucaguccucaccgguuuggcgaaacaaaaggaaauuccgcaccauugauuauccgcgagcccuucauugccugcgggccuaaggaauguaaacauuuugcucugacccacuacgcagcccagccaggcgguuauuacaacgggacgcgaggagaccguaauaagcuaagacaucucaucucugugaagcugggcaaaauaccgacugucgagaacagcaucuuccacauggcugccugguccggcucagcgugccaugaugggaaggaguggaccuauauuggaguggacggucccgauaauaacgcacuucugaaaaucaaguacggcgaagccuacacagacacuuaucacaguuacgcuaauaacauuuugaggacccaggagagcgccuguaauugcaucgggggaaacuguuaucucaugauaacagauggcucugcauccgguauuucagaaugccgguuucugaaaauccgcgaggggagaauuaucaaggagaucuucccuaccggaaggguuaagcacacggaagaguguacuugcggcuuugcuagcaauaaaacaauugaaugugccugccgggacaacaguuacaccgcgaagcgcccauucgugaaauuaaaugucgagacugauacagccgaaauacgacugaugugcaccgagacguaucucgacacccccagaccugaugacggcucuaucacagggccaugugaguccaacggagauaaggguagcggcgggauuaaaggaggcuuugugcaucaaaggauggcaucgaagaucggucggugguacucucguacuauguccaaaaccaagcgcauggggaugggccuuuauguaaaguacgacggagaccccugggcugauucagacgcccuggcuuugaguggcguuauggugagcauggaggaaccggggugguacuccuucggauuugaaauaaaagauaagaaaugcgacgucccuuguauugguaucgagauggugcacgauggcgggaaggaaacauggcauucugccgcaacugccaucuauugccuaaugggaagcggccagcugcucugggacaccgugacaggugucgauauggcucuguga

SEQ ID NO: 151209 - RNA, 1401 nt, Artificial Sequence
  derived and/or modified sequence opt3 from neuraminidase__InfluenzaB__AGX16922
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaaggaauguaaacauuucgcucuuacccacuacgcagcccagccaggcgguuauuacaacgggacgcgaggagaccguaauaaguugagacaucugaucagcgugaagcuaggcaaaauaccgacugucgagaacuccaucuuucacauggcugccuggucaggcagugcgugccaugaugggaaggaguggaccuauauuggaguggacggucccgauaauaacgcacuccugaaaaucaaguacggcgaagccuacacagacacuuaucacagcuacgcuaauaacauucuuaggacccaggagucugccuguaauugcaucgggggaaacuguuaucugaugauaacagauggcuccgcaucagguauuagcgaaugccgguucuugaaaauccgcgaggggagaauuaucaaggagaucuuuccuaccggaaggguuaagcacacggaagaguguacuugcggcuucgcuaguaauaaaacaauugaaugugccugccgggacaacucuuacaccgcgaagcgcccauuugugaaacucaaugucgagacugauacagccgaaauacgacugaugugcaccgagacguauuuagacacccccagaccugaugacggcuccaucacagggccaugugagagcaacggagauaaggguucgggcgggauuaaaggaggcuucgugcaucaaaggauggcaucuaagaucggucggugguacucccguacuaugucaaaaaccaagcgcauggggaugggccuguauguaaaguacgacggagaccccugggcugauagugacgcccucgcucuuagcggcguuaugguguccauggaggaaccggggugguacucuuuuggauucgaaauaaaagauaagaaaugcgacgucccuuguauugguaucgagauggugcacgauggcgggaaggaaacauggcauagcgccgcaacugccaucuauugccugaugggaucaggccaguugcuaugggacaccgugacaggugucgauauggcucuguga

SEQ ID NO: 151210 - RNA, 1401 nt, Artificial Sequence
  derived and/or modified sequence opt3 from neuraminidase__InfluenzaB__AGX16933
augcugcccagcaccauccagacacucacucuuuuccugacguccggcgggguguuguuaucucuguacgucucagccagucuaagcuaucuccuguacuccgacauucuucugaaguuuucuccuaccgagauaaacgcuccaacaaugccguuggauugcgcaaaugccucgaacguucaagcggugaauagaucagcuacuaaaggaguaacccuccugcugcccgaaccugaguggacauauccaaggcucagcugucccgguaguaccuuccagaaggccuuacugaucuccccucaccgguuuggcgaaacuaaagggaacucugcaccacuuauuauccgcgagcccuucauugccugcggaccuaaggaauguaaacauuuugcuuugacacacuacgcagcccagccaggcgguuauuacaaugggacccgaggagaccguaacaagcugagacaucuaaucagcgugaagcucggcaaaauaccgacggucgaaaauuccaucuuccacauggcugccuggucaggcagugcgugccaugaugggaaggaguggacuuauauuggaguggacggucccgauaacaaugcacugcuuaaaaucaaguacggcgaagccuacaccgacacauaucacagcuacgcuaacaauauucugaggacucaggagucugccuguaacugcaucgggggaaauuguuauuugaugauaaccgauggcuccgcaucagguauuagcgaaugccgguuucucaaaauccgcgaggggagaauuaucaaggagaucuucccuacaggaaggguuaagcacaccgaagaguguacgugcggcuuugcuaguaacaaaacuauugaaugugccugccgggacaauucuuacacagcgaagcgcccauucgugaaacugaacgucgagaccgauacugccgaaauacgauuaaugugcacagagaccuaucuggacacgcccagaccugaugacggcuccaucaccgggccaugugagagcaacggagauaaggguucgggcgggauuaaaggaggcuuugugcaucaaaggauggcaucuaagaucggucggugguacucccguacaaugucaaaaacuaagcgcauggggaugggccucuauguaaaguacgacggagaccccugggcugauagugacgcccuugcucugagcggcguuaugguguccauggaggagccggggugguacucuuucggauuugaaauaaaagauaagaaaugcgacgucccuuguauugguaucgagauggugcacgauggcgggaaggaaaccuggcauagcgccgcaacagccaucuauugcuugaugggaucaggccagcuacugcucgacacugugaccggugucgauauggcucuguga

SEQ ID NO: 151211 - RNA, 1401 nt, Artificial Sequence
  derived and/or modified sequence opt3 from neuraminidase__InfluenzaB__AGX16944
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacagcgggacgcgaggagaccguaacaagcugagacaucuaaucuccgugaagcucggcaaaauaccgacugucgaaaauucaaucuuccacauggcugccuggaguggcagcgcgugccaugaugggaaggaguggaccuauauuggaguggacggucccgauaacaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggccaugugagucgaauggagauaaggguucuggcgggauuaaaggaggcuuugugcaucaaaggauggcauccaagaucggucggugguacucacguacuaugaguaaaaacaagcgcauggggaugggccucuauguaaaguacgacggagaccccugggcugauagcgacgcccuugcucuguccggcguuauggugucuauggaggagccggggugguacagcuucggauuugaaauaaaagauaagaaaugcgacgucccuuguauugguaucgagauggugcacgauggcgggaaggaaaccuggcauucagccgcaacagccaucuauugcuugaugggaaguggccagcuacugugggacacugugaccggugucgauauggcucucuga

SEQ ID NO: 151212 - RNA, 1401 nt, Artificial Sequence; identical to SEQ ID NO: 150632
  derived and/or modified sequence opt3 from neuraminidase__InfluenzaB__AGX16955

SEQ ID NO: 151213 - RNA, 1401 nt, Artificial Sequence; identical to SEQ ID NO: 150630
  derived and/or modified sequence opt3 from neuraminidase__InfluenzaB__AGX16966

SEQ ID NO: 151214 - RNA, 1401 nt, Artificial Sequence; identical to SEQ ID NO: 150632
  derived and/or modified sequence opt3 from neuraminidase__InfluenzaB__AGX16977

SEQ ID NO: 151215 - RNA, 1401 nt, Artificial Sequence; identical to SEQ ID NO: 150632
  derived and/or modified sequence opt3 from neuraminidase__InfluenzaB__AGX16988

SEQ ID NO: 151216 - RNA, 1401 nt, Artificial Sequence; identical to SEQ ID NO: 151176
  derived and/or modified sequence opt3 from neuraminidase__InfluenzaB__AGX16999

SEQ ID NO: 151217 - RNA, 1401 nt, Artificial Sequence; identical to SEQ ID NO: 150632
  derived and/or modified sequence opt3 from neuraminidase__InfluenzaB__AGX17010

SEQ ID NO: 151218 - RNA, 1401 nt, Artificial Sequence; identical to SEQ ID NO: 151178
  derived and/or modified sequence opt3 from neuraminidase__InfluenzaB__AGX17021

SEQ ID NO: 151219 - RNA, 1401 nt, Artificial Sequence
  derived and/or modified sequence opt3 from neuraminidase__InfluenzaB__AGX17032
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucggacguucaagcggugaauagaucagcuaccaaaggaguaacacuccugcugcccgaaccugaguggaccuauccaaggcucagcugucccgguaguacuuuccagaaggccuuacugaucuccccucaccgguuuggcgaaacaaaagggaacucugcaccacuuauuauccgcgagcccuucauugccugcggaccuaaggaauguaaacauuuugcuuugacccacuacgcagcccagccaggcgguuauuacaaucgaacgcguggggauagaaacaagcugaggcaucuaaucagcgugaagcucggaaaaauaccgacugucgaaaauuccaucuuccacauggcugccuggucaggcagugcgugccaugacggcaaggaguggaccuauauugggguggauggacccgacaacaaugcacugcuuaaaaucaaguacggugaagccuacacagauacuuaucacagcuacgcuaacaauauucugcggacccaggagucugccuguaacugcaucggcgggaauuguuauuugaugauaacagacggauccgcaucaggcauuagcgaaugccgcuuucucaaaaucagagaggguaggauuaucaaggagaucuucccuaccgggcggguuaagcacacggaagaguguacuugcggauuugcuaguaacaaaacaauugaaugugccugccgcgauaauucuuacaccgcgaagcgaccauucgugaaacugaacgucgagacugacacagccgaaauaagauuaaugugcaccgagacguaucuggauacccccaggccugacgauggcuccaucacaggcccaugugagagcaauggggacaagggaucggguggcauuaaagggggauuugugcaucaacggauggcaucuaagaucggccguugguacucccgcacuaugucaaaaaccaagagaauggguauggggcucuauguaaaguacgacggcgaucccugggcugacagugaugcccuugcucugagcggaguuaugguguccauggaggagccgggcugguacucuuucggguuugaaauaaaagacaagaaaugcgaugucccuuguauuggaaucgagauggugcacgacgguggcaaggaaacauggcauagcgccgcaacugccaucuauugcuugauggggucaggacagcuacugugggauaccgugacaggcgucgacauggcucucuga

SEQ ID NO: 151220 - RNA, 1401 nt, Artificial Sequence; identical to SEQ ID NO: 150630
  derived and/or modified sequence opt3 from neuraminidase__InfluenzaB__AGX17043

SEQ ID NO: 151221 - RNA, 1401 nt, Artificial Sequence
  derived and/or modified sequence opt3 from neuraminidase__InfluenzaB__AGX17054
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaacgguaauggcgggauuaagggaggcuuugugcaucaaaggauggcaucgaaaaucggucggugguacucucguacuauguccaagaccaaacgcauggggaugggccucuauguaaaguacgacggagaccccugggcugauucagacgcccuugcucugaguggcguuauggugagcauggaggaaccggggugguacuccuucggauuugaaauaaaggauaaaaagugcgacgucccuuguauugguaucgagauggugcacgauggcgggaaagaaacauggcauucugccgcaacugccaucuauugcuugaugggaagcggccagcuacugugggacaccgugacaggugucgauauggcucucuga

SEQ ID NO: 151222 - RNA, 1401 nt, Artificial Sequence
  derived and/or modified sequence opt3 from neuraminidase__InfluenzaB__AGX17065
augcugcccagcaccauccagacacucacucuuuuccugacguccggcgggguguuguuaucucuguacgucucagcccuacucaguuaucugcuuuacagcgacauucuguugaaguuuuccccuaccaaaauaaucgcuccaacaacuucucucgauucggcaaacgccucaaauuuccaagcgguuaaccacagcgcuaccaaggagaugacauuucugcugccggaacccgaguggaccuauccuagacucaguugccagggauccacuuuccagaaagccuuacugauuucuccacauagguuuggugaagcaaagggcaauagcgcuccccuuaucauucgggagccuuucaucgccugugggccaaaagaaugcaagcacuuugcauugacacauuacgccgcucagcccggaggcuauuacaacgguacccgcgaggaccgaaauaagcugcgucaccuaauauccgugaaccucgggaaaaucccuacgguagaaaauucaauuuuccauauggccgcguggaguggaagcgcaugucacgauggcagagaauggacuuauaucggcguggacgggccagauucuaacgcccugauuaagaucaaauacggagaggcuuacaccgacacauaucacuccuacgccaauaacauacuuaggacucaagaaucagcaugcaauuguauugguggcgauugcuaucugaugaucaccgacgggagcgcuaguggaauuucuaagugucgguuuuugaaaauccgcgagggcagaaucauuaaggagauauucccgacagguagggucgaacauaccgaggaaugcacguguggguuugccuccaacaagacuaucgagugcgcgugucgggauaauagcuacacagccaaacgccccuucgugaagcucaacguugaaaccgacacugcagagauucgacugaugugcacagagaccuauuuagauacgccuagaccagacgauggaucgaucaccggccccugcgaaucuaauggcgacaaaggguccggagguauaaagggcggguuugugcaccagaggauggcuucaaaaauuggacggugguacagucguacaaucagcaagacuaaacgcaugggcauggagcuguaugucaaguacgacggugauccuuggaccgacuccgaugcccucgcuccaucuggggugaugguaagcaucgaggagcccggcugguacucauucggauucgaaauuaaggacaaaaagugugauguuccgugcaucggcauugagauggugcaugacgggggaaaaacaacuuggcacagugccgcaaccgccauauauugucuuauggguuccggccagcuguugugggauacagucaccgggguggacauggcucuauga

SEQ ID NO: 151223 - RNA, 1401 nt, Artificial Sequence
  derived and/or modified sequence opt3 from neuraminidase__InfluenzaB__AGX17076
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccugggcugauagugacgcccuugcucugagcggcguuaugguguccauggaggaaccggggugguacucuuucggauuugaaauaagagauaaaaagugcgacgucccuuguauugguaucgagaucgugcacgauggcgggaaagaaacauggcauagcgccgcaacugccauuuauugcuugaugggaucaggccagcuacugugggacaccgugacaggugucgauauggcucucuga

SEQ ID NO: 151224 - RNA, 1401 nt, Artificial Sequence; identical to SEQ ID NO: 151178
  derived and/or modified sequence opt3 from neuraminidase__InfluenzaB__AGX17087

SEQ ID NO: 151225 - RNA, 1401 nt, Artificial Sequence; identical to SEQ ID NO: 151178
  derived and/or modified sequence opt3 from neuraminidase__InfluenzaB__AGX17098

SEQ ID NO: 151226 - RNA, 1401 nt, Artificial Sequence; identical to SEQ ID NO: 151178
  derived and/or modified sequence opt3 from neuraminidase__InfluenzaB__AGX17109

SEQ ID NO: 151227 - RNA, 1401 nt, Artificial Sequence; identical to SEQ ID NO: 151178
  derived and/or modified sequence opt3 from neuraminidase__InfluenzaB__AGX17120

SEQ ID NO: 151228 - RNA, 1401 nt, Artificial Sequence; identical to SEQ ID NO: 150630
  derived and/or modified sequence opt3 from neuraminidase__InfluenzaB__AGX17131

SEQ ID NO: 151229 - RNA, 1401 nt, Artificial Sequence; identical to SEQ ID NO: 150632
  derived and/or modified sequence opt3 from neuraminidase__InfluenzaB__AGX17142

SEQ ID NO: 151230 - RNA, 1401 nt, Artificial Sequence
  derived and/or modified sequence opt3 from neuraminidase__InfluenzaB__AGX17153
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucauugggccaugugagagcaacggagauaaggguucgggcgggaucaaaggaggcuuugugcaucaaaggauggcaucuaagauaggucggugguacucccguacaaugucaaaaacuaagcgcauggggaugggccucuauguaaaguacgacggagaccccugggcugauagugacgcccuugcucugagcggcguuaugguguccauggaggaaccggggugguacucuuucggauuugaaauuaaagauaagaaaugcgacgucccuuguaucgguaucgagauggugcacgauggcgggaaggaaaccuggcauagcgccgcaacagccauuuauugcuugaugggaucaggccagcuacugugggacacugugaccggugucgauauggcucucuga

SEQ ID NO: 151231 - RNA, 1401 nt, Artificial Sequence; identical to SEQ ID NO: 151178
  derived and/or modified sequence opt3 from neuraminidase__InfluenzaB__AGX17164

SEQ ID NO: 151232 - RNA, 1404 nt, Artificial Sequence
  derived and/or modified sequence opt3 from neuraminidase__InfluenzaB__AGX17175
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcuccccgaaccugaguggaccuauccaagguuaagcugucccgguaguacuuuccagaaggcccugcuuaucuccccucaccgguuuggcgaaacaaaaggaaauucugcaccauugauuauccgcgagcccuucauugccugcgggccuaaggaauguaaacauuuugcucugacccacuacgcagcccagccaggcgguuauuacaacgggacgcgaggagaccguaauaagcuaagacaucucaucagcgugaagcugggcaaaauaccgacugucgagaacuccaucuuccacauggcugccuggucaggcagugcgugccaugaugggaaggaguggaccuauauuggaguggacggucccgauaauaacgcacuucugaaaaucaaguacggcgaagccuacacagacacuuaucacagcuacgcuaauaacauuuugaggacccaggagucugccuguaauugcaucgggggaaacuguuaucucaugauaacagauggcuccgcaucagguauuagcgaaugccgguuucugaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaauuaaaugucgagacugauacagccgaaauacgacugaugugcaccgagacguaucucgacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccuuuauguaaaguacgacggagaccccugggcugauagugacgcccuggcuuugagcggcguuaugguguccauggaggaaccggggugguacucuuucggauuugaaauaagagauaaaaagugcgacgucccuuguauugguaucgagauggugcacgauggcgggaaagaaacauggcauagcgccgcaacugccaucuauugccuaaugggaucaggccagcugcucugggacaccgugacaggugucgauauggcucuguga

SEQ ID NO: 151233 - RNA, 1401 nt, Artificial Sequence
  derived and/or modified sequence opt3 from neuraminidase__InfluenzaB__AGX17186
augcugcccagcaccauccagacacucacucuuuuccugacguccggcgggguguuguuaucucuguacgucucagccagucuaagcuaucuccuguacuccgacauucuucugaaguuuucuccuaccgagauaacaacuccaaccaugccguuggauugcgcuaacgcaucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaaggaauguaaacauuuugccuugacgcacuacgcugcacagccaggcgguuauuacaacgggacucgaggagaccguaauaagcugagacaucuaaucagcgugaagcucggcaaaauaccgaccgucgagaacuccaucuuccacauggccgcuuggucaggcagugccugccaugaugggaaggaguggacauauauuggaguggacggucccgauaauaacgcgcugcuuaaaaucaaguacggcgaagcauacacugacaccuaucacagcuacgccaauaacauucugaggacacaggagucugcuuguaauugcaucgggggaaacuguuauuugaugauaaccgauggcuccgccucagguauuagcgaaugccgguuucucaaaauccgcgaggggagaauuaucaaggagaucuucccuacgggaaggguuaaguacacugaagaguguacaugcggcuuugcaaguaauaaaaccauugaaugugcuugccgggacaacucuuauacugccaagcgcccauucgugaaacugaaugucgagacagauaccgcggaaauacgauuaaugugcacggagaccuaccuggacacacccagaccugaugacggcuccaucacugggccaugugagagcaacggagauaaggguucgggcgggauuaaaggaggcuuugugcaccaaaggauggccucuaagaucggucggugguauucccguaccaugucaaaaacacgcagaauggggaugggccucuacguaaaguacgacggagaccccugggcagauagugacgcucuugcccugagcggcguuaugguguccauggaggaaccggggugguauucuuucggauuugaaauaaaggauaaaaagugcgacgucccuuguauugguaucgagauggugcaugauggcgggaaagaaacuuggcacagcgcugccaccgcaaucuacugcuugaugggaucaggccagcuacugugggacacagugaccggugucgauauggcccucuga

SEQ ID NO: 151234 - RNA, 1401 nt, Artificial Sequence; identical to SEQ ID NO: 151209
  derived and/or modified sequence opt3 from neuraminidase__InfluenzaB__AGX17197

SEQ ID NO: 151235 - RNA, 1401 nt, Artificial Sequence
  derived and/or modified sequence opt3 from neuraminidase__InfluenzaB__AGX17208
augcugcccagcaccauccagacacucacucuuuuccugacguccggcgggguguuguuaucucuguacgucucagccagucuaagcuaucuccuguacuccgacauucuucugaaguuuucuccuaccgagauaacaacuccaaccaugccguuggauugcgcuaacgcaucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaaggaauguaaacauuuugccuugacgcacuacgcugcacagccaggcgguuauuacaacgggacucgaggagaccguaauaagcugagacaucuaaucagcgugaagcucggcaaaauaccgaccgucgagaacuccaucuuccacauggccgcuuggucaggcagugccugccaugaugggaaggaguggacauauauuggaguggacggucccgauaauaacgcgcugcuuaaaaucaaguacggcgaagcauacacugacaccuaucacagcuacgccaauaacauucugaggacacaggagucugcuuguaauugcaucgggggaaacuguuauuugaugauaaccgauggcuccgccucagguauuagcgaaugccgguuucucaaaauccgcgaggggagaauuaucaaggagaucuucccuacgggaaggguuaagcacacugaagaguguacaugcggcuuugcaaguaauaaaaccauugaaugugcuugccgggacaacucuuacacugccaagcgcccauucgugaaacugaaugucgagacagauaccgcggaaauacgauuaaugugcacggagaccuaucuggacacacccagaccugaugacggcuccaucacugggccaugugagagcaacggagauaaggguucgggcgggauuaaaggaggcuuugugcaucaaaggauggccucuaagaucggucggugguacucccguaccaugucaaaaacacgcagaauggggaugggccucuauguaaaguacgacggagaccccugggcagauagugacgcucuugcccugagcggcguuaugguguccauggaggaaccggggugguacucuuucggauuugaaauaaaggauaaaaagugcgacgucccuuguauugguaucgagauggugcacgauggcgggaaagaaacuuggcauagcgcugccaccgcaaucuauugcuugaugggaucaggccagcuacugugggacacagugaccggugucgauauggcccucuga

SEQ ID NO: 151236 - RNA, 1401 nt, Artificial Sequence; identical to SEQ ID NO: 151178
  derived and/or modified sequence opt3 from neuraminidase__InfluenzaB__AGX17219

SEQ ID NO: 151237 - RNA, 1401 nt, Artificial Sequence; identical to SEQ ID NO: 150632
  derived and/or modified sequence opt3 from neuraminidase__InfluenzaB__AGX17230

SEQ ID NO: 151238 - RNA, 1401 nt, Artificial Sequence; identical to SEQ ID NO: 151178
  derived and/or modified sequence opt3 from neuraminidase__InfluenzaB__AGX17241

SEQ ID NO: 151239 - RNA, 1401 nt, Artificial Sequence
  derived and/or modified sequence opt3 from neuraminidase__InfluenzaB__AGX17252
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaacucgaguggaccuauccuagguuaagcuguccagguaguacuuuccagaaggcccugcuuaucucuccccaccgguuuggcgaaacaaaaggaaauuccgcaccuuugauuauccgcgagccauucauugccugcgggcccaaggaauguaaacauuuugcucugaccuacuaugcagcccagccuggcgguuacuauaacgggacgcgaggagaccguaauaagcuaagacaccucaucagcgugaagcugggcaaaauaccaacugucgagaacuccaucuuccauauggcugccuggucaggcagugcgugccacgaugggaaggaguggaccuacauuggaguggacgguccggauaauaacgcacuucugaaaaucaaguacggcgaagccuauacagacacuuaccauagcuaugcuaauaacauuuugaggacccaggagucugccuguaauugcaucgggggaaacuguuaccucaugauaacagauggcuccgcaucagguauuagcgaaugccgguuucugaaaauccgcgaggggagaauuaucaaggagaucuuccccaccggaaggguuaagcacacggaagaguguacuugcggcuuugcuaguaauaaaacaauugaaugugccugccgggacaacucuuauaccgcgaagcgcccuuucgugaaauuaaaugucgagacugauacagccgaaauacgacugaugugcaccgagacguaccucgacaccccaagacccgcagauggcuccaucacagggccuugugagagcaacggagacaaggguucgggcgggauuaaaggaggcuuugugcaccaaaggauggcuucuaagaucggucggugguauucccguacuaugucaaaaaccaagcgcauggggaugggccuuuacguaaaguacgauggagacccaugggccgacagugaugcucuggccuugagcggcguuaugguguccauggaggaacccgggugguauucuuucggauuugaaauaaaagacaagaaaugcgaugucccguguauugguaucgagauggugcaugacggcgggaaggaaacauggcacagcgcagccacugcuaucuacugccuaaugggaucaggccagcugcucugggauaccgugacaggugucgacauggcgcuguga

SEQ ID NO: 151240 - RNA, 1401 nt, Artificial Sequence
  derived and/or modified sequence opt3 from neuraminidase__InfluenzaB__AGX17263
augcugcccagcaccauccagacacucacucuuuuccugacguccggcgggguguuguuaucucuguacgucucagccagucuaagcuaucuccuguacuccgacauucuucugaaguugucuccuaccgagauaacagcuccaacuaugccgcucgauugcgcaaacgccucgaauguucaagcggugaacagaucagcuaccaaaggaguaacacugcugcuccccgaaccugaguggaccuauccaagguuaagcugucccgguaguacuuuucagaaggcccugcuuaucuccccucaccgguucggcgaaacaaaaggaaauucugcaccauugauuauccgcgagcccuuuauugccugcgggccuaaggaauguaaacauuucgcucugacccacuacgcagcccagccaggcgguuauuacaacgggacgcgaggagaccguaauaagcuaagacaucucaucagcgugaagcugggcaaaauaccgacugucgagaacuccaucuuucacauggcugccuggucaggcagugcgugccaugaugggaaggaguggaccuauauuggaguggacggucccgauaauaacgcacuucugaaaaucaaguacggcgaagccuacacagacacuuaucacagcuacgcuaauaacauuuugaggacccaggagucugccuguaauugcaucgggggaaacuguuaucucaugauaacagauggcuccgcaucagguauuagcgaaugccgguuccugaaaauccgcgaggggagaauuaucaaggagaucuuuccuaccggaaggguuaagcacacggaagaguguacuugcggcuucgcuaguaauaaaacaauugaaugugccugccgggacaacucuuacaccgcgaagcgcccauuugugaaauuaaaugucgagacugauacagccgaaauacgacugaugugcaccgagacguaucucgacacccccagaccugaugacggcuccaucacagggccaugugagagcaacggagauaaggguucgggcgggauuaaaggaggcuucgugcaucaaaggauggcaucuaagaucggucggugguacucccguacuaugucaaaaaccaagcgcauggggaugggccuuuauguaaaguacgacggagaccccugggcugauagugacgcccuggcuuugagcggcguuaugguguccauggaggaaccggggugguacucuuuuggauucgaaauaaaagauaagaaaugcgacgucccuuguauugguaucgagauggugcacgauggcgggaaggaaacauggcauagcgccgcaacugccaucuauugccuaaugggaucaggccagcugcucugggacaccgugacaggugucgauauggcucuguga

SEQ ID NO: 151241 - RNA, 1401 nt, Artificial Sequence
  derived and/or modified sequence opt3 from neuraminidase__InfluenzaB__AGX17274
augcugcccagcaccauccagacacucacucuuuuccugacguccggcgggguguuguuaucucuguacgucucagccagucuaagcuaucuccuguacuccgacauucuucugaaguuuucuccuaccgagauaaacgcuccaacaaugccguuggauugcgcaaaugccucgaacguucaagcggugaauagaucagcuacuaaaggaguaacccuccugcugcccgaaccugaguggacauauccaaggcucagcugucccgguaguaccuuccagaaggccuuacugaucuccccucaccgguuuggcgaaacuaaagggaacucugcaccacuuauuauccgcgagcccuucauugccugcggaccuaaggaauguaaacauuuugcuuugacacacuacgcagcccagccaggcgguuauuacaaugggacccgaggagaccguaacaagcugagacaucuaaucagcgugaagcucggcaaaauaccgacggucgaaaauuccaucuuccacauggcugccuggucaggcagugcgugccaugaugggaaggaguggacuuauauuggaguggacggucccgauaacaaugcacugcuuaaaaucaaguacggcgaagccuacaccgacacauaucacagcuacgcuaacaauauucugaggacucaggagucugccuguaacugcaucgggggaaauuguuauuugaugauaaccgauggcuccgcaucagguauuagcgaaugccgguuucucaaaauccgcgaggggagaauuaucaaggagaucuucccuacaggaaggguuaagcacaccgaagaguguacgugcggcuuugcuaguaacaaaacuauugaaugugccugccgggacaauucuuacacagcgaagcgcccauucgugaaacugaacgucgagaccgauacugccgaaauacgauuaaugugcacagagaccuaucuggacacgcccagaccugaugacggcuccaucaccgggccaugugagagcaacggagauaaggguucgggcgggauuaaaggaggcuuugugcaucaaaggauggcaucuaagaucggucggugguacucccguacaaugucaaaaacuaagcgcauggggaugggccucuauguaaaguacgacggagaccccugggcugauagugacgcccuugcucugagcggcguuaugguguccauggaggagccggggugguacucuuucggauuugaaauaaaagauaagaaaugcgacgucccuuguauugguaucgagauggugcacgauggcgggaaggaaaccuggcauagcgccgcaacagccaucuauugcuugaugggaucaggccagcuacugugggacacugugaccggugucgauauggcucucuga

SEQ ID NO: 151242 - RNA, 1401 nt, Artificial Sequence
  derived and/or modified sequence opt3 from neuraminidase__InfluenzaB__AGX17285
augcugcccagcaccauccagacacucacucuuuuccugacguccggcgggguguuguuaucucuguacaugucagccagucuaagcuaucuccuguacuccgacauucuucugaaguuuucuccuaccgagauaacagcuccaacuaugccguuggauugcgcaaacgccucgaauguccaagcgguuaacagaucagcuaccaaaggagugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcguaaagcucggcaaaauaccgacuguggagaacuccaucuuccacauggcugccuggucaggcagugcgugccaugaugggaaggaguggaccuauauuggagucgacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaagggugaagcacacggaagaguguacuugcggcuuugcuaguaauaaaacaauugaaugugccugccgggacaacucuuacaccgcgaagcgcccauucguuaaacugaauguggagacugauacagccgaaauacgauuaaugugcaccgagacguaucuggacacccccagaccugaugacggcuccaucacagggccaugugagagcaacggagauaaggguucgggcgggauuaaaggaggcuuuguccaucaaaggauggcaucuaagaucggucggugguacucccguacuaugucaaaaaccaagcgcauggggaugggccucuaugugaaguacgacggagaccccugggcugauagugacgcccuugcucugagcggcguaaugguuuccauggaggaaccggggugguacucuuucggauuugaaauaaaagauaagaaaugcgacgugccuuguauugguaucgagaugguccacgauggcgggaaggaaacauggcauagcgccgcaacugccaucuauugcuugaugggaucaggccagcuacugugggacaccgugacagguguggauauggcucucuga

SEQ ID NO: 151243 - RNA, 1401 nt, Artificial Sequence
  derived and/or modified sequence opt3 from neuraminidase__InfluenzaB__AGX17296
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaagcaaaaggaaauucugccccacuuauuauccgcgagcccuucauugcuugcgggccuaaggaauguaaacauuuugcauugacacacuacgccgcucagccaggcgguuauuacaacgggacccgaggagaccguaauaagcugagacaucuaaucagcgugaagcucggcaaaauaccgacggucgagaacuccaucuuccacauggccgcguggucaggcagugcaugccaugaugggaaggaguggacuuauauuggaguggacggucccgauaauaacgcccugcuuaaaaucaaguacggcgaggcuuacaccgacacauaucacagcuacgccaauaacauucugaggacucaggagucugcauguaauugcaucgggggaaacuguuauuugaugauaaccgauggcuccgcuucagguauuagcgaaugccgguuucucaaaauccgcgaggggagaauuaucaaggagaucuucccuacaggaaggguuaagcacaccgaagaguguacgugcggcuuugccaguaauaaaacuauugaaugugcgugccgggacaacucuuacacagccaagcgcccauucgugaaacugaaugucgagaccgauacugcagaaauacgauuaaugugcacagagaccuaucuggacacgcccagaccugaugacggcuccaucaccgggccaugugagagcaacggagauaaggguucgggcgggauuaaaggaggcuuugugcaucaaaggauggcuucuaagaucggucggugguacucccguacaaugucaaaaacuaagcgcauggggaugggccucuauguaaaguacgacggagaccccugggccgauagugacgcucuugcccugagcggcguuaugguguccauggaagaaccggggugguacucuuucggauuugaaauaaaagauaagaaaugcgacgucccuuguauugguaucgagauggugcacgauggcgggaaggaaaccuggcauagcgcagccacagcuaucuauugcuugaugggaucaggccagcuacugugggacacugugaccggugucgauauggcgcucuga

SEQ ID NO: 151244 - RNA, 1401 nt, Artificial Sequence; identical to SEQ ID NO: 151176
  derived and/or modified sequence opt3 from neuraminidase__InfluenzaB__AGX17307

SEQ ID NO: 151245 - RNA, 1401 nt, Artificial Sequence; identical to SEQ ID NO: 150630
  derived and/or modified sequence opt3 from neuraminidase__InfluenzaB__AGX17318

SEQ ID NO: 151246 - RNA, 1401 nt, Artificial Sequence
  derived and/or modified sequence opt3 from neuraminidase__InfluenzaB__AGX17329
augcugcccagcaccauccagacacucacucuuuuccugacguccggcgggguguuguuaucucuguacgucucagccagucuaagcuaucuccuguacuccgacaugcuucugaaguuuucuccuaccgagauuacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugauauccccucaccgguuuggcgaaacaaaaggaaauucugcaccacuuaucauucgcgagcccuucaucgccugcgggccuaaggaauguaaacauuuugcuuugacccacuacgcagcccagccaggcgguuauuacagcgggacgcgaggagaccguaacaagcugagacaucuaauuuccgugaagcucggcaaaaucccgacugucgaaaauucaauauuccacauggcugccuggaguggcagcgcgugccaugaugggaaggaguggaccuauaucggaguggacggucccgauaacaaugcacugcuuaaaauuaaguacggcgaagccuacacagacacuuaucacucuuacgcuaacaauauccugaggacccaggaguccgccuguaacugcauugggggaaauuguuauuugaugaucacagauggcucagcaagcgguauaagugaaugccgguuucucaaaauucgcgaggggagaaucauuaaggagaucuucccuaccggaaggguuaagcacacggaagaguguacuugcggcuuugcuucuaacaaaacaaucgaaugugccugccgggacaauuccuacaccgcgaagcgcccauucgugaaacugaacgucgagacugauacagccgaaauucgauuaaugugcaccgagacguaucuggacacccccagaccugaugacggcagcauaacagggccaugugagucgaauggagauaaggguucuggcgggaucaaaggaggcuuugugcaucaaaggauggcauccaagauuggucggugguacucacguacuaugaguaaaaacaagcgcauggggaugggccucuauguaaaguacgacggagaccccugggcugauagcgacgcccuugcucuguccggcguuauggugucuauggaggagccggggugguacagcuucggauuugaaaucaaagauaagaaaugcgacgucccuuguauagguauugagauggugcacgauggcgggaaggaaaccuggcauucagccgcaacagccaucuauugcuugaugggaaguggccagcuacugugggacacugugaccggugucgauauggcucucuga

SEQ ID NO: 151247 - RNA, 1401 nt, Artificial Sequence; identical to SEQ ID NO: 151178
  derived and/or modified sequence opt3 from neuraminidase__InfluenzaB__AGX17340

SEQ ID NO: 151248 - RNA, 1401 nt, Artificial Sequence
  derived and/or modified sequence opt3 from neuraminidase__InfluenzaB__AGX17351
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagacuaacggagauaaggguagcggcgggauuaaaggaggcuuugugcaucaaaggauggcaucgaagaucggucggugguacucucguaccauguccaaaacaaagcgcauggggaugggccucuauguaaaguacgacggagaccccugggcugauucagacgcccuugcucugaguggcguuauggugagcauggaggaaccggggugguacuccuucggauuugaaauaaaagauaagaaaugcgacgucccuuguauugguaucgagauggugcacgauggcgggaaggaaacuuggcauucugccgcaaccgccaucuauugcuugaugggaagcggccagcuacugugggacacagugaccggugucgauauggcucucuga

SEQ ID NO: 151249 - RNA, 1401 nt, Artificial Sequence
  derived and/or modified sequence opt3 from neuraminidase__InfluenzaB__AGX17362
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaucccguuggauugcgcaaacgccucgaauauucaagcgguuaacagaucagcuaccaaaggagugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauagccugcgggccuaaggaauguaaacauuuugcuuugacccacuacgcagcccagccaggcgguuauuacaacgggacgcgaggagaccguaauaagcugagacaucuaaucagcguaaagcucggcaaaauuccgacuguggagaacuccaucuuccacauggcugccuggucaggcagugcgugccaugaugggaaggaguggaccuauauuggagucgacggucccgauaauaacgcacugcuuaaaaucaaguacggcgaagccuacacagacacuuaucacagcuacgcuaauaacauacugaggacccaggagucugccuguaauugcauugggggaaacuguuauuugaugaucacagauggcuccgcaucagguauuagcgaaugccgguuucucaaaauccgcgaggggagaaucauuaaggagauauucccuaccggaagggugaagcacacggaagaguguacuugcggcuuugcuaguaauaaaacaaucgaaugugccugccgggacaacucuuacaccgcgaagcgcccauucguuaaacugaauguggagacugauacagccgaaauucgauuaaugugcaccgagacguaucuggacacccccagaccugaugacggcuccaucacagggccaugugagagcaacggagauaaggguucgggcgggauaaaaggaggcuuuguccaucaaaggauggcaucuaagauuggucggugguacucccguacuaugucaaaaaccaagcgcauggggaugggccucuaugugaaguacgacggagaccccugggcugauagugacgcccuugcucugagcggcguaaugguuuccauggaggaaccggggugguacucuuucggauuugaaaucaaagauaagaaaugcgacgugccuuguaucgguauugagaugguccacgauggcgggaaggaaacauggcauagcgccgcaacugccaucuauugcuugaugggaucaggccagcuacugugggacaccgugacagguguggauauggcucucuga

SEQ ID NO: 151250 - RNA, 1401 nt, Artificial Sequence
  derived and/or modified sequence opt3 from neuraminidase__InfluenzaB__AGX17373
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaauaacaaaacaaucgaaugugccugccgggacaauaguuacaccgcgaagcgcccauucgucaaacugaacguggagacugauacagccgaaauucgauuaaugugcaccgagacguaucuggacacccccagaccugaugacggcucuauaacagggccaugugaguccaacggagauaaggguagcggcgggaucaaaggaggcuuuguacaucaaaggauggcaucgaagauuggucggugguacucucguacuauguccaaaaccaagcgcauggggaugggccucuauguuaaguacgacggagaccccugggcugauucagacgcccuugcucugaguggcgugauggucagcauggaggaaccggggugguacuccuucggauuugaaaucaaagauaagaaaugcgacgugccuuguauagguauugagauggugcacgauggcgggaaggaaacauggcauucugccgcaacugccaucuauugcuugaugggaagcggccagcuacugugggacaccgucacagguguuaauauggcucucuga

SEQ ID NO: 151251 - RNA, 1401 nt, Artificial Sequence; identical to SEQ ID NO: 150630
  derived and/or modified sequence opt3 from neuraminidase__InfluenzaB__AGX17384

SEQ ID NO: 151252 - RNA, 1401 nt, Artificial Sequence; identical to SEQ ID NO: 150698
  derived and/or modified sequence opt3 from neuraminidase__InfluenzaB__AGX17395

SEQ ID NO: 151253 - RNA, 1401 nt, Artificial Sequence
  derived and/or modified sequence opt3 from neuraminidase__InfluenzaB__AGX17404
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacgguagcgauaauaacgcacugcuuaaaaucaaguacggcgaagccuacacagacacuuaucacucuuacgcuaauaacauucugaggacccaggaguccgccuguaauugcaucgggggaaacuguuauuugaugauaacagauggcucagcaagcgguauuagugaaugccgguuucucaaaauccgcgaggggagaauuaucaaggagaucuuccccaccggaaggguuaagcacacggaagaguguacuugcggcuuugcuucuaauaaaacaauugaaugugccugccgggacaacuccuacaccgcgaagcgcccuuucgugaaacugaaugucgagacugauacagccgaaauacgauuaaugugcaccgagacguaucuggacaccccaagacccgaugacggcagcaucacagggccuugugagucgaacggagauaaggguucuggcgggauuaaaggaggcuuugugcaucaaaggauggcauccaagaucggucggugguacucacguacuaugaguaaaaccaagcgcauggggaugggccucuauguaaaguacgacggagacccaugggcugauagcgacgcccuugcucuguccggcauaaugguuucuauggaggaacccgggugguacagcuucggauuugaaauuaaagauaagaaaugcgacgugccguguaucgguaucgagaugguccacgauggcgggaaggaaacauggcauucagccgcaacugccauuuauugcuugaugggaaguggccagcuacugugggacaccgugacagguguggauauggcucucuga

SEQ ID NO: 151254 - RNA, 1401 nt, Artificial Sequence
  derived and/or modified sequence opt3 from neuraminidase__InfluenzaB__AGX17415
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugacuggaccuauccaaggcucagcugucccgguaguacuuuccagaaggccuuacugaucuccccucaccgguuuggcgagacaaaaggaaauucugcaccacuuauuauccgcgaacccuucauugccugcgggccuaaggaguguaaacauuuugcuuugacccacuacgcagcccagccaggcgguuauuacaacgggacgcgaggagaucguaauaagcugagacaucuaaucagcgugaagcucggcaaaauaccgacugucgaaaacuccaucuuccacauggcugccuggucaggcagugcgugccaugacgggaaggaguggaccuauauuggaguggauggucccgacaauaacgcacugcuuaaaaucaaguacggcgaggccuacacagauacuuaucacagcuacgcuaauaacauucugaggacccaggaaucugccuguaauugcaucgggggaaacuguuauuugaugauaacagacggcuccgcaucagguauuagcgagugccgguuucucaaaauccgcgaagggagaauuaucaaggagaucuucccuaccggaaggguuaagcacacggaggaauguacuugcggcuuugcuaguaauaaaacaauugagugugccugccgggauaacucuuacaccgcgaagcgcccauucgugaaacugaaugucgaaacugacacagccgagauacgauuaaugugcaccgaaacguaucuggauacccccagaccugacgauggcuccaucacagggccaugugagagcaacggagacaaggguucgggcgggauuaaaggaggcuuugugcaucaaaggauggcaucuaagaucggucggugguacucccguacuaugucaaaaaccaagcgcauggggaugggccucuauguaaaguacgacggagaucccugggcugacagugaugcccuugcucugagcggcguuaugguguccauggaggaaccggggugguacucuuucggauuugagauaaaagacaagaaaugcgaugucccuuguauugguaucgaaauggugcacgacggcgggaaggagacauggcauagcgccgcaacugccaucuauugcuugaugggaucaggccagcuacugugggauaccgugacaggugucgacauggcucucuga

SEQ ID NO: 151255 - RNA, 1401 nt, Artificial Sequence
  derived and/or modified sequence opt3 from neuraminidase__InfluenzaB__AGX17426
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaaggaauguaaacauuucgcucuuacccacuacgcagcccagccaggcgguuauuacaacgggacgcgaggagaccguaauaaguugagacaucugaucagcgugaagcuaggcaaaauaccgacugucgagaacuccaucuuucacauggcugccuggucaggcagugcgugccaugaugggaaggaguggaccuauauuggaguggacggucccgauaauaacgcacuccugaaaaucaaguacggcgaagccuacacagacacuuaucacagcuacgcuaauaacauucuuaggacccaggagucugccuguaauugcaucgggggaaacuguuaucugaugauaacagauggcuccgcaucagguauuagcgaaugccgguucuugaaaauccgcgaggggagaauuaucaaggagaucuuuccuaccggaaggguuaagcacacggaagaguguacuugcggcuucgcuaguaauaaaacaauugaaugugccugccgggacaacucuuacaccgcgaagcgcccauuugugaaacucaaugucgagacugauacagccgaaauacgacugaugugcaccgagacguauuuagacacccccagaccugaugacggcuccaucacagggccaugugagagcaacggagauaaggguucgggcgggauuaaaggaggcuucgugcaucaaaggauggcaucuaagaucggucggugguacucccguacuaugucaaaaaccaagcgcauggggaugggccuguauguaaaguacgacggagaccccugggcugauagugacgcccucgcucuuagcggcguuaugguguccauggaggaaccggggugguacucuuuuggauucgaaauaagagauaaaaagugcgacgucccuuguauugguaucgagauggugcacgauggcgggaaagaaacauggcauagcgccgcaacugccaucuauugccugaugggaucaggccaguugcuaugggacaccgugacaggugucgauauggcucuguga

SEQ ID NO: 151256 - RNA, 1401 nt, Artificial Sequence
  derived and/or modified sequence opt3 from neuraminidase__InfluenzaB__AGX17437
augcugcccagcaccauccagacacucacucuuuuccugacguccggcgggguguuguuaucucuguacgucucaguuagucuaagcuaucuccuguacuccgacauucuucugaaguuuucuccuaccgagauaacagcccaaacuaugccauuggauuucgcuaacgcaucgaaugugcaggccguaaacagaucagcgaccaaaggagugacacuccugcugccggaacccgaguggaccuauccuaggcucagcugcccagguaguacuuuucagaaggcuuuacugaucucuccccaccgguucggcgaaacaaaaggaaauuccgccccucuuauuauccgcgagccauuuauugcaugugggcccaaggaaugcaaacauuucgccuugacccacuacgcugcacagccuggcgguuauuacaacgggacgcgaggagaccguaauaagcugagacaucuaaucagcgucaagcucggcaaaauaccaacuguggagaacuccaucuuucacauggccgcuuggucaggcagugccugucaugaugggaaggaguggaccuauauuggaguugacgguccggauaauaacgcgcugcuuaaaaucaaguacggcgaagcauacacagacacuuaucacagcuacgccaauaacauucugaggacccaagagucugcuugcaauuguaucgggggaaacugcuauuugaugauaacagauggcuccgccucagguauuagcgaaugucgguuccucaaaauccgcgaggggagaauuaucaaggagaucuuucccaccggaagggugaagcacacggaagagugcacuuguggcuucgcaaguaauaaaacaauugaaugcgcuugucgggacaacucuuacaccgccaagcgcccuuuugucaaacugaauguggagacugauacagcggaaauacgauuaaugugcaccgagacguaucuggacaccccaagacccgaugacggcuccaucacagggccuugcgagagcaacggagauaaggguucgggcgggauuaaaggaggcuucguacaucagaggauggccucuaagaucggucggugguacucccguacuaugucaaaaaccaagcgcauggggaugggccucuauguuaaguacgacggagacccaugggcagauagugacgcucuugcccugagcggcgugauggucuccauggaggaacccgggugguacucuuuuggauucgaaauaagagauaaaaagugugacgugccgugcauugguaucgagauggugcacgauggcgggaaagaaacauggcauagcgcugccacugcaaucuauuguuugaugggaucaggccagcuacugugggacaccgucacagguguugauauggcccucuga

SEQ ID NO: 151257 - RNA, 1401 nt, Artificial Sequence
  derived and/or modified sequence opt3 from neuraminidase__InfluenzaB__AGX17448
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagacuaacggagauaaggguagcggcgggauuaaaggaggcuuugugcaucaaaggauggcaucgaagaucggucggugguacucucguaccauguccaaaacaaagcgcauggggaugggccucuauguaaaguacgacggagaccccugggcugauucagacgcccuuguucugaguggcgugauggucagcauggaggaaccggggugguacuccuucggauuugaaauaaaagauaagaaaugcgacgugccuuguauugguaucgagauggugcacgauggcgggaaggaaacuuggcauucugcugccaccgcaaucuauugcuugaugggaagcggccagcuacugugggacacagucaccgguguugauauggcccucuga

SEQ ID NO: 151258 - RNA, 1401 nt, Artificial Sequence
  derived and/or modified sequence opt3 from neuraminidase__InfluenzaB__AGX17459
augcugcccagcaccauccagacacucacucuuuuccugacguccggcgggguguuguuaucucuguacgucucagccagucuaagcuaucuccuguacuccgacauucuucugaaguuuucuccuaccgagauaacagcuucgacuaugccauuggauugcgcaaacgccucaaauguucaagcggugaacagaagcgcuaccaaaggaguaacacuccugcugccggaacccgacuggaccuauccuaggcucaguuguccagguuccacuuuccagaaggccuuacugaucucuccccaccgguuuggcgagacaaaagggaauagcgcaccucuuauuauccgcgaaccauucauugccugcggacccaaggaguguaaacauuuugcuuugacccacuacgcagcccagccuggcgguuauuacaacgggacgcgaggagaucguaauaagcugagacaucuaaucuccgugaagcucggcaaaauaccaacugucgaaaacucaaucuuccacauggcugccuggaguggcagcgcgugccaugacgggaaggaguggaccuauauuggaguggaugguccggacaauaacgcacugcuuaaaaucaaguacggcgaggccuacacagauacuuaucacucuuacgcuaauaacauucugaggacccaggaauccgccuguaauugcaucgggggaaacuguuauuugaugauaacagacggcucagcaagcgguauuagugagugccgguuucucaaaauccgcgaagggagaauuaucaaggagaucuuccccaccggaaggguuaagcacacggaggaauguacuugcggcuuugcuucuaauaaaacaauugagugugccugccgggauaacuccuacaccgcgaagcgcccuuucgugaaacugaaugucgaaacugacacagccgagauacgauuaaugugcaccgaaacguaucuggauaccccaagacccgacgauggcagcaucacagggccuugugagucgaacggagacaaggguucuggcgggauuaaaggaggcuuugugcaucaaaggauggcauccaagaucggucggugguacucacguacuaugaguaaaaccaagcgcauggggaugggccucuauguaaaguacgacggagauccaugggcugacagcgaugcccuugcucuguccggcguuauggugucuauggaggaacccgggugguacagcuucggauuugagauaaaagacaagaaaugcgaugucccguguauugguaucgaaauggugcacgacggcgggaaggagacauggcauucagccgcaacugccaucuauugcuugaugggaaguggccagcuacugugggauaccgugacaggugucgacauggcucucuga

SEQ ID NO: 151259 - RNA, 1401 nt, Artificial Sequence; identical to SEQ ID NO: 150630
  derived and/or modified sequence opt3 from neuraminidase__InfluenzaB__AGX17470

SEQ ID NO: 151260 - RNA, 1401 nt, Artificial Sequence
  derived and/or modified sequence opt3 from neuraminidase__InfluenzaB__AGX17481
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacucauccugcccgaaccugaguggaccuauccaaggcugagcugucccgguaguacuuuccagaaggcccucuuaauuuccccucaccgguuuggcgaaacaaaaggaaauucugcaccacugaucauucgcgagcccuucaucgccugcgggccuaaggaauguaaacauuuugcucuuacccacuacgcagcccagccaggcgguuauuacaacgggacgcgaggagaccguaauaaguugagacaucugauaagcgugaagcuaggcaaaaucccgacugucgagaacuccauuuuccacauggcugccuggucaggcagugcgugccaugaugggaaggaguggaccuauaucggaguggacggucccgauaauaacgcacuccugaaaauuaaguacggcgaagccuacacagacacuuaucacagcuacgcuaauaacauccuuaggacccaggagucugccuguaauugcauagggggaaacuguuaucugaugauuacagauggcuccgcaucagguaucagcgaaugccgguuuuugaaaauucgcgaggggagaaucaucaaggagauuuucccuaccggaaggguuaagcacacggaagaguguacuugcggcuuugcuaguaauaaaacaauagaaugugccugccgggacaacucuuacaccgcgaagcgcccauucgugaaacucaaugucgagacugauacagccgaaauccgacugaugugcaccgagacguauuuagacacccccagaccugaugacggcuccauuacagggccaugugagagcaacggagauaaggguucgggcgggaucaaaggaggcuuugugcaucaaaggauggcaucuaagauaggucggugguacucccguacuaugucaaaaaccaagcgcauggggaugggccuguauguaaaguacgacggagaccccugggcugauagugacgcccucgcucuuagcggcguuaugguguccgucgaggaaccggggugguacucuuucggauuugaaauuaaagauaagaaaugcgacgugccuuguaucgguaucgagauggugcacgauggcgggaaggaaacauggcauagcgccgcaacugccauuuauugccugaugggaucaggccaguugcuaugggacaccgucacagguguugauauggcucuguga

SEQ ID NO: 151261 - RNA, 1401 nt, Artificial Sequence
  derived and/or modified sequence opt3 from neuraminidase__InfluenzaB__AGX17492
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccugggcugauagugacgcccuugcucugagcggcguuaugguguccauggaggaaccggggugguacucuuucggauuugaaauaaaagauaagaaaugcgacgucccuuguauugguaucgagauggugcacgauggcgggaaggaaacauggcauagcgccgcaacugccaucuauugcuugaugggaucaggccagcuacugugggacaccgugacaggugucgauauugcucucuga

SEQ ID NO: 151262 - RNA, 1401 nt, Artificial Sequence
  derived and/or modified sequence opt3 from neuraminidase__InfluenzaB__AGX17503
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguuuaacuuuccagaaggcccugcuuaucaguccucaccgguuuggcgaaacaaaaggaaauuccgcaccauugauuauccgcgagcccuucauugccugcgggccuaaggaauguaaacauuuugcucugacccacuacgcagcccagccaggcgguuauuacaacgggacgcgaggagaccguaauaagcuaagacaucucaucucugugaagcugggcaaaauaccgacugucgagaacagcaucuuccacauggcugccugguccggcucagcgugccaugaugggaaggaguggaccuauauuggaguggacggucccgauaauaacgcacuucugaaaaucaaguacggcgaagccuacacagacacuuaucacaguuacgcuaauaacauuuugaggacccaggagagcgccuguaauugcaucgggggaaacuguuaucucaugauaacagauggcucugcauccgguauuucagaaugccgguuucugaaaauccgcgaggggagaauuaucaaggagaucuucccuaccggaaggguuaagcacacggaagaguguacuugcggcuuugcuagcaauaaaacaauugaaugugccugccgggacaacaguuacaccgcgaagcgcccauucgugaaauuaaaugucgagacugauacagccgaaauacgacugaugugcaccgagacguaucucgacacccccagaccugaugacggcucuaucacagggccaugugaguccaacggagauaaggguagcggcgggauuaaaggaggcuuugugcaucaaaggauggcaucgaagaucggucggugguacucucguacuauguccaaaaccaagcgcauggggaugggccuuuauguaaaguacgacggagaccccugggcugauucagacgcccuggcuuugaguggcguuauggugagcauggaggaaccggggugguacuccuucggauuugaaauaaaagauaagaaaugcgacgucccuuguauugguaucgagauggugcacgauggcgggaaggaaacauggcauucugccgcaacugccaucuauugccuaaugggaagcggccagcugcucugggacaccgugacaggugucgauauggcucuguga

SEQ ID NO: 151263 - RNA, 1401 nt, Artificial Sequence; identical to SEQ ID NO: 150630
  derived and/or modified sequence opt3 from neuraminidase__InfluenzaB__AGX17514

SEQ ID NO: 151264 - RNA, 1401 nt, Artificial Sequence
  derived and/or modified sequence opt3 from neuraminidase__InfluenzaB__AGX17525
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggaagcgaggagaccguaauaagcugagacaucuaaucagcgugaaacucggcaagauaccgacggucgagaacuccaucuuccacauggcugccuggucaggcagugcgugccaugaugggaaagaguggacuuauauuggaguggacggucccgauaauaacgcacugcuuaagaucaaauacggcgaagccuacaccgacacauaucacagcuacgcuaauaacauucugaggacucaggagucugccuguaauugcaucgggggaaacuguuauuugaugauaaccgauggcuccgcaucagguauuagcgaaugccgguuucucaagauccgcgaggggagaauuaucaaggagaucuucccuacaggaaggguuaaacacaccgaagaguguacgugcggcuuugcuaguaauaagacuauugaaugugccugccgggacaacucuuacacagcgaaacgcccauucgugaagcugaaugucgagaccgauacugccgaaauacgauuaaugugcacagagaccuaucuggacacgcccagaccugaugacggcuccaucaccgggccaugugagagcaacggagauaaagguucgggcgggauuaagggaggcuuugugcaucaaaggauggcaucuaaaaucggucggugguacucccguacaaugucaaagacuaagcgcauggggaugggccucuauguaaaauacgacggagaccccugggcugauagugacgcccuugcucugagcggcguuaugguguccauggaggaaccggggugguacucuuucggauuugaaauaagagauaagaaaugcgacgucccuuguauugguaucgagauggugcacgauggcgggaaggaaaccuggcauagcgccgcaacagccaucuauugcuugaugggaucaggccagcuacugugggacacugugaccggugucgauauggcucucuga

SEQ ID NO: 151265 - RNA, 1401 nt, Artificial Sequence; identical to SEQ ID NO: 151209
  derived and/or modified sequence opt3 from neuraminidase__InfluenzaB__AGX17536

SEQ ID NO: 151266 - RNA, 1401 nt, Artificial Sequence; identical to SEQ ID NO: 151240
  derived and/or modified sequence opt3 from neuraminidase__InfluenzaB__AGX17547

SEQ ID NO: 151267 - RNA, 1401 nt, Artificial Sequence
  derived and/or modified sequence opt3 from neuraminidase__InfluenzaB__AGX17558
augcugcccagcaccauccagacacucacucuuuuccugacguccggcgggguguuguuaucucuguacgucucagccagucuaagcuaucuccuguacuccgacguucuucugaaguuuucuccugcugagauuaccgcaccaacaaugccguuggauugcgccaacgcgucgaaugugcaagcuguaaacagaucagccacuaaaggagugacccuccugcugcccgaaccugaguggacauauccaaggcucagcugucccgguaguaccuuccagaaggcauuacugauauccccucaccgguuuggcgaaacuaaaggaaauucugccccacuuaucauucgcgagcccuucaucgcuugcgggccuaaggaauguaaacauuuugcauugacacacuacgccgcucagccaggcgguuauuacaacgggacccgaggagaccguaauaagcugagacaucuaauuagcgucaagcucggcaaaaucccgacgguggagaacuccauauuccacauggccgcguggucaggcagugcaugccaugaugggaaggaguggacuuauaucggaguugacggucccgauaauaacgcccugcuuaaaauuaaguacggcgaggcuuacaccgacacauaucacagcuacgccaauaacauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaagggucaagcacaccgaagaguguacgugcggcuuugccaguaauaaaacuaucgaaugugcgugccgggacaacucuuacacagccaagcgcccauucgugaaacugaauguagagaccgauacugcagaaauccgauuaaugugcacagagaccuaucuggacacgcccagaccugaugacggcuccauuaccgggccaugugagagcaacggagauaaggguucgggcgggauaaaaggaggcuuuguucaucaaaggauggcuucuaagaucggucggugguacucccguacaaugucaaaaacuaagcgcauggggaugggccucuaugugaaguacgacggagaccccugggccgauagugacgcucuugcccugagcggcgucaugguguccauggaagaaccggggugguacucuuucggauuugaaauuaaagauaagaaaugcgacgugccuuguaucgguauagagaugguccacgauggcgggaaggaaaccuggcauagcgcagccacagcuauuuauugcuugaugggaucaggccagcuacugugggacacuguuaccgguguggauauggcgcucuga

SEQ ID NO: 151268 - RNA, 1401 nt, Artificial Sequence; identical to SEQ ID NO: 150759
  derived and/or modified sequence opt3 from neuraminidase__InfluenzaB__AGX17569

SEQ ID NO: 151269 - RNA, 1401 nt, Artificial Sequence; identical to SEQ ID NO: 150686
  derived and/or modified sequence opt3 from neuraminidase__InfluenzaB__AGX17580

SEQ ID NO: 151270 - RNA, 1401 nt, Artificial Sequence
  derived and/or modified sequence opt3 from neuraminidase__InfluenzaB__AGX17591
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaagcucggcaaaauacccacugucgagaacagcaucuuccacauggcugccugguccggcucagcgugccaugaugggaaggaguggaccuauauuggaguggacgguccugauaauaacgcacugcuuaaaaucaaguacggcgaagccuacacagacacuuaucacaguuacgcuaauaacauucugaggacccaggagagcgccuguaauugcaucgggggaaacuguuauuugaugauaacagauggcucugcauccgguguuucagaaugccgguuucucaaaauucgcgaggggagaaucauuaaggagaucuucccaaccggaagggugaagcacacggaagaguguacuugcggcuuugcuagcaauaaaacaaucgaaugugccugccgggacaacaguuacaccgcgaagcgccccuucgucaaacugaauguggagacugauacagccgaaauucgauuaaugugcaccgagacguaucuggacaccccuagaccagaugacggcucuauaacagggcccugugaguccaacggagauaaggguagcggcgggaucaaaggaggcuuuguacaucaaaggauggcaucgaagauuggucggugguacucucguacuauguccaaaaccaagcgcauggggaugggccucuauguuaaguacgacggagacccgugggcugauucagacgcccuugcuuucaguggcgugauggucagcauggaggaaccugggugguacuccuuuggauucgaaaucaaagauaagaaaugcgacgugcccuguauagguauugagauggugcacgauggcgggaaggaaacauggcauucugccgcaacugccaucuauugccugaugggaagcggccaguugcuaugggacaccgucacagguguuaacauggcucuguga

SEQ ID NO: 151271 - RNA, 1401 nt, Artificial Sequence; identical to SEQ ID NO: 150684
  derived and/or modified sequence opt3 from neuraminidase__InfluenzaB__AGX17602

SEQ ID NO: 151272 - RNA, 1401 nt, Artificial Sequence; identical to SEQ ID NO: 151270
  derived and/or modified sequence opt3 from neuraminidase__InfluenzaB__AGX17613

SEQ ID NO: 151273 - RNA, 1401 nt, Artificial Sequence; identical to SEQ ID NO: 150857
  derived and/or modified sequence opt3 from neuraminidase__InfluenzaB__AGX17624

SEQ ID NO: 151274 - RNA, 1401 nt, Artificial Sequence
  derived and/or modified sequence opt3 from neuraminidase__InfluenzaB__AGX17635
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaagcucggcaaaauacccacugucgagaacagcaucuuccacauggcugccugguccggcucagcgugccaugaugggaaggaguggaccuauauuggaguggacgguccugauaauaacgcacugcuuaaaaucaaguacggcgaagccuacacagacacuuaucacaguuacgcuaauaacauucugaggacccaggagagcgccuguaauugcaucgggggaaacuguuauuugaugauaacagauggcucugcauccgguauuucagaaugccgguuucucaaaauccgcgaggggagaauuaucaaggagaucuucccaaccggaaggguuaagcacacggaagaguguacuugcggcuuugcuagcaauaaaacaauugaaugugccugccgggacaacaguuacaccgcgaagcgccccuucgugaaacugaaugucgagacugauacagccgaaauacgauuaaugugcaccgagacguaucuggacaccccuagaccagaugacggcucuaucacagggcccugugaguccaacggagauaaggguagcggcgggauuaaaggaggcuuugugcaucaaaggauggcaucgaagaucggucggugguacucucguacuauguccaaaaccaagcgcauggggaugggccucuauguaaaguacgacggagacccgugggcugauucagacgcccuugcuuucaguggcguuauggugagcauggaggaaccugggugguacuccuuuggauucgaaauaaaagauaagaaaugcgacguccccuguauugguaucgagauggugcacgauggcgggaaggaaacauggcauucugccgcaacugccaucuauugccugaugggaagcggccaguugcuaugggacaccgugacaggugucaacauggcucuguga

SEQ ID NO: 151275 - RNA, 1401 nt, Artificial Sequence; identical to SEQ ID NO: 150857
  derived and/or modified sequence opt3 from neuraminidase__InfluenzaB__AGX17657

SEQ ID NO: 151276 - RNA, 1401 nt, Artificial Sequence; identical to SEQ ID NO: 151270
  derived and/or modified sequence opt3 from neuraminidase__InfluenzaB__AGX17668

SEQ ID NO: 151277 - RNA, 1401 nt, Artificial Sequence
  derived and/or modified sequence opt3 from neuraminidase__InfluenzaB__AGX17679
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagauugauacugccgaaauacgauuaaugugcacagacaccuaucuggauacgcccagaccugacgauggcuccaucaccgggccaugugagagcaacggagacaaagguucgggcgggauuaagggaggcuuuguacaucaaaggauggcaucuaaaaucggucggugguacucccguacaaugucaaagacugagcgcauggggaugggccucuauguuaaauacgacggagaucccugggcugacagugaugcccuugcuuucagcggcgugauggucuccaugaaggaaccggggugguacucuuuuggauucgagauaaaggacaaaaagugcgaugugccuuguauugguaucgaaauggugcacgacggcgggaaagagaccuggcauagcgccgcaacagccaucuauugccugaugggaucaggccaguugcuaugggauacugucaccgguguugacauggcucuguga

SEQ ID NO: 151278 - RNA, 1401 nt, Artificial Sequence; identical to SEQ ID NO: 150857
  derived and/or modified sequence opt3 from neuraminidase__InfluenzaB__AGX17690

SEQ ID NO: 151279 - RNA, 1401 nt, Artificial Sequence
  derived and/or modified sequence opt3 from neuraminidase__InfluenzaB__AGX17701
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggaagcgaggagaccguaauaagcugagacaucuaaucucugugaaacucggcaagauacccacggucgagaacagcaucuuccacauggcugccugguccggcucagcgugccaugaugggaaagaguggacuuauauuggaguggacgguccugauaauaacgcacugcuuaagaucaaauacggcgaagccuacaccgacacauaucacaguuacgcuaauaacauucugaggacucaggagagcgccuguaauugcaucgggggaaacuguuauuugaugauaaccgauggcucugcauccgguguuucagaaugccgguuucucaagauucgcgaggggagaaucauuaaggagaucuucccaacaggaagggugaaacacaccgaagaguguacgugcggcuuugcuagcaauaagacuaucgaaugugccugccgggacaacaguuacacagcgaaacgccccuucgucaagcugaauguggagaccgauacugccgaaauucgauuaaugugcacagagaccuaucuggacacgccuagaccagaugacggcucuauaaccgggcccugugaguccaacggagauaaagguagcggcgggaucaagggaggcuuuguacaucaaaggauggcaucgaaaauuggucggugguacucucguacaauguccaagacuaagcgcauggggaugggccucuauguuaaauacgacggagacccgugggcugauucagacgcccuugcuuucaguggcgugauggucagcauggaggaaccugggugguacuccuuuggauucgaaaucaaggauaaaaagugcgacgugcccuguauagguauugagauggugcacgauggcgggaaagaaaccuggcauucugccgcaacagccaucuauugccugaugggaagcggccaguugcuaugggacacugucaccgguguuaacauggcucuguga

SEQ ID NO: 151280 - RNA, 1401 nt, Artificial Sequence; identical to SEQ ID NO: 150857
  derived and/or modified sequence opt3 from neuraminidase__InfluenzaB__AGX17723

SEQ ID NO: 151281 - RNA, 1401 nt, Artificial Sequence; identical to SEQ ID NO: 151277
  derived and/or modified sequence opt3 from neuraminidase__InfluenzaB__AGX17734

SEQ ID NO: 151282 - RNA, 1401 nt, Artificial Sequence
  derived and/or modified sequence opt3 from neuraminidase__InfluenzaB__AGX17745
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguagcgguaguacuuuccagaaggccuuacugaucuccccucaccgguuuggcgaaauuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacauccugaggacucaggagucugccuguaauugcauagggggaaacuguuauuugaugauuaccgauggcuccgcaucagguguuagcgaaugccgguuucucaaaauccgcgaggggagaauuaucaaggagaucuucccuacaggaagggugaagcacaccgaagaguguacgugcggcuuugcuaguaauaaaacuauugaaugugccugccgggacaacucuuacacagcgaagcgcccauucgucaaacugaauguggagaccgauacugccgaaauacgauuaaugugcacagagaccuaucuggacacgcccagaccugaugacggcuccaucaccgggccaugugagagcaacggagauaaggguucgggcgggauuaaaggaggcuuuguacaucaaaggauggcaucuaagaucggucggugguacucccguacaaugucaaaaacuaagcgcauggggaugggccucuauguuaaguacgacggagaccccugggcugauagugacgcccuugcuuucagcggcgugauggucuccauggaggaaccggggugguacucuuuuggauucgaaauaaaagauaagaaaugcgacgugccuuguauugguaucgagauggugcacgauggcgggaaggaaaccuggcauagcgccgcaacagccaucuauugccugaugggaucaggccaguugcuaugggacacugucaccgguguuaacauggcucuguga

SEQ ID NO: 151283 - RNA, 1401 nt, Artificial Sequence
  derived and/or modified sequence opt3 from neuraminidase__InfluenzaB__AGX17756
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccgaccaggcgguuauuacaaugggacgcguggagacagaaacaaacugaggcaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugcggacccaggagucugccuguaacugcaucgggggaaauuguuauuugaugauaacagauggcuccgcaucagguguuagcgaaugccgcuuucucaagauuagagaggggaggaucauuaaagagaucuucccuaccggacgggugaagcauacggaagaguguacuugcggcuuugcuaguaacaagacaaucgaaugugccugccgcgacaauucuuacaccgcgaaacgaccauucgucaagcugaacguggagacugauacagccgaaauuagauuaaugugcaccgacacguaucuggauacccccaggccugacgauggcuccauaacagggccaugugagagcaacggagacaaagguucgggcgggaucaagggaggcuuuguacaccagcggauggcaucuaaaauuggucguugguacucccgcacuaugucaaagaccgagagaauggggaugggccucuauguuaaauacgacggagaucccugggcugacagugaugcccuugcuuucagcggcgugauggucuccaugaaggaaccggggugguacucuuuuggauucgagaucaaggacaaaaagugcgaugugccuuguauagguauugaaauggugcaugacggcgggaaagagacauggcacagcgccgcaacugccaucuauugccugaugggaucaggccaguugcuaugggauaccgucacagguguugacauggcucuguga

SEQ ID NO: 151284 - RNA, 1401 nt, Artificial Sequence; identical to SEQ ID NO: 150904
  derived and/or modified sequence opt3 from neuraminidase__InfluenzaB__AGX17767

SEQ ID NO: 151285 - RNA, 1401 nt, Artificial Sequence
  derived and/or modified sequence opt3 from neuraminidase__InfluenzaB__AGX17778
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaccagaggauggcaucuaaaauuggucggugguacucccguacuaugucaaagaccgagcgcauggggaugggccucuauguuaaauacgacggagaucccugggcugaaagugacgcccuugcuuucagcggcgugauggucuccaugaaggagccggggugguacucuuuuggauucgaaaucaaggauaaaaagugcgacgugccuuguauagguauugagauggugcaugauggcgggaaagaaacauggcacagcgccgcaacugccaucuauugccugaugggaucaggccaauugcuaugggacaccgucacagguguugauauggcucuguga

SEQ ID NO: 151286 - RNA, 1401 nt, Artificial Sequence
  derived and/or modified sequence opt3 from neuraminidase__InfluenzaB__AGX17789
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagauugauacugccgaaauacgauuaaugugcacagacaccuaucuggauacgcccagaccugacgauggcuccaucaccgggccaugugagagcaacggagacaaagguucgggcgggauuaagggaggcuuuguacaucaaaggauggcaucuaaaaucggucggugguacucccguacaaugucaaagacugagcgcauggggaugggccucuauguuaaauacgacggagaucccugggcugacagugaugcccuuguguucagcggcgucaugguguccaugaaggaaccggggugguacucuuuuggauucgagauaaaggacaaaaagugcgaugugccuuguauugguaucgaaaugguccacgacggcgggaaagagaccuggcauagcgcugccacagcaaucuauugccugaugggaucaggccaguugcuaugggauacuguuaccgguguggacauggcccuguga

SEQ ID NO: 151287 - RNA, 1401 nt, Artificial Sequence; identical to SEQ ID NO: 150857
  derived and/or modified sequence opt3 from neuraminidase__InfluenzaB__AGX17800

SEQ ID NO: 151288 - RNA, 1401 nt, Artificial Sequence
  derived and/or modified sequence opt3 from neuraminidase__InfluenzaB__AGX17811
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaagcucggcaaaauacccacugucgagaacagcaucuuccacauggcugccugguccggcucagcgugccaugaugggaaggaguggaccuauauuggaguggacgguccugauaauaacgcacugcuuaaaaucaaguacggcgaagccuacacagacacuuaucacaguuacgcuaauaacauucugaggacccaggagagcgccuguaauugcaucgggggaaacuguuauuugaugauaacagauggcucugcauccgguguuucagaaugccgguuucucaaaauucgcgaggggagaaucauuaaggagaucuucccaaccggaagggugaagcacacggaagaguguacuugcggcuuugcuagcaauaaaacaaucgaaugugccugccgggacaacaguuacaccgcgaagcgccccuucgucaaacugaauguggagacugauacagccgaaauucgauuaaugugcaccgagacguaucuggacaccccuagaccagaugacggcucuauaacagggcccugugaguccaacggagauaaggguagcggcgggaucaaaggaggcuuuguacaucaaaggauggcaucgaagauuggucggugguacucucguacuauguccaaaaccaagcgcauggggaugggccucuauguuaaguacgacggagacccgugggcugauucagacgcccuugcuuucaguggcgugauggucagcauggaggaaccugggugguacuccuuuggauucgaaaucaaagauaagaaaugcgacgugcccuguauagguauugagauggugcacgauggcgggaaggaaacauggcauucugccgcaacugccaucuauugccugaugggaagcggccaguugcuaugggacaccgucacagguguuaacauggcucaguga

SEQ ID NO: 151289 - RNA, 1401 nt, Artificial Sequence; identical to SEQ ID NO: 151270
  derived and/or modified sequence opt3 from neuraminidase__InfluenzaB__AGX17822

SEQ ID NO: 151290 - RNA, 1401 nt, Artificial Sequence
  derived and/or modified sequence opt3 from neuraminidase__InfluenzaB__AGX17833
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucuauaaagcucggcaaaauccccacuguggagaacagcauuuuccacauggcugccugguccggcucagcgugccaugaugggaaggaguggaccuauaucggagucgacgguccugauaauaacgcacugcuuaaaauuaaguacggcgaagccuacacagacacuuaucacaguuacgcuaauaacauccugaggacccaggagagcgccuguaauugcauagggggaaacuguuauuugaugauuacagauggcucugcauccggugugucagaaugccgguuucucaaaauccgcgaggggagaauuaucaaggagaucuucccaaccggaaggguuaagcacacggaagaguguacuugcggcuuugcuagcaauaaaacaauugaaugugccugccgggacaacaguuacaccgcgaagcgccccuucgugaaacugaaugucgagacugauacagccgaaauacgauuaaugugcaccgagacguaucuggacaccccuagaccagaugacggcucuaucacagggcccugugaguccaacggagauaaggguagcggcgggauuaaaggaggcuuugugcaucaaaggauggcaucgaagaucggucggugguacucucguacuauguccaaaaccaagcgcauggggaugggccucuauguaaaguacgacggagacccgugggcugauucagacgcccuugcuuucaguggcguuauggugagcauggaggaaccugggugguacuccuuuggauucgaaauaaaagauaagaaaugcgacguccccuguauugguaucgagauggugcacgauggcgggaaggaaacauggcauucugccgcaacugccaucuauugccugaugggaagcggccaguugcuaugggacaccgugacaggugucaacauggcucuguga

SEQ ID NO: 151291 - RNA, 1401 nt, Artificial Sequence; identical to SEQ ID NO: 151277
  derived and/or modified sequence opt3 from neuraminidase__InfluenzaB__AGX17844

SEQ ID NO: 151292 - RNA, 1401 nt, Artificial Sequence; identical to SEQ ID NO: 151285
  derived and/or modified sequence opt3 from neuraminidase__InfluenzaB__AGX17855

SEQ ID NO: 151293 - RNA, 1401 nt, Artificial Sequence; identical to SEQ ID NO: 150904
  derived and/or modified sequence opt3 from neuraminidase__InfluenzaB__AGX17866

SEQ ID NO: 151294 - RNA, 1401 nt, Artificial Sequence; identical to SEQ ID NO: 151270
  derived and/or modified sequence opt3 from neuraminidase__InfluenzaB__AGX17877

SEQ ID NO: 151295 - RNA, 1401 nt, Artificial Sequence; identical to SEQ ID NO: 151277
  derived and/or modified sequence opt3 from neuraminidase__InfluenzaB__AGX17888

SEQ ID NO: 151296 - RNA, 1401 nt, Artificial Sequence; identical to SEQ ID NO: 151270
  derived and/or modified sequence opt3 from neuraminidase__InfluenzaB__AGX17899

SEQ ID NO: 151297 - RNA, 1401 nt, Artificial Sequence; identical to SEQ ID NO: 151277
  derived and/or modified sequence opt3 from neuraminidase__InfluenzaB__AGX17910

SEQ ID NO: 151298 - RNA, 1401 nt, Artificial Sequence; identical to SEQ ID NO: 151277
  derived and/or modified sequence opt3 from neuraminidase__InfluenzaB__AGX17921

SEQ ID NO: 151299 - RNA, 1401 nt, Artificial Sequence; identical to SEQ ID NO: 150904
  derived and/or modified sequence opt3 from neuraminidase__InfluenzaB__AGX17932

SEQ ID NO: 151300 - RNA, 1401 nt, Artificial Sequence
  derived and/or modified sequence opt3 from neuraminidase__InfluenzaB__AGX17943
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaggcucggcaagauacccacugucgagaacagcaucuuccacauggcugccugguccggcucagcgugccaugaugggaaagaguggaccuauauuggaguggacgguccugauaauaacgcacugcuuaagaucaaauacggcgaagccuacacagacacuuaucacaguuacgcuaauaacauucugcggacccaggagagcgccuguaauugcaucgggggaaacuguuauuugaugauaacagauggcucugcauccgguguuucagaaugccgcuuucucaagauuagagaggggaggaucauuaaagagaucuucccaaccggacgggugaagcacacggaagaguguacuugcggcuuugcuagcaauaagacaaucgaaugugccugccgcgacaacaguuacaccgcgaaacgacccuucgucaagcugaauguggagacugauacagccgaaauuagauuaaugugcaccgagacguaucuggacaccccuaggccagaugacggcucuauaacagggcccugugaguccaacggagauaaagguagcggcgggaucaagggaggcuuuguacaucaacggauggcaucgaaaauuggucguugguacucucgcacuauguccaagaccaaaagaauggggaugggccucuauguuaaguacgacggagacccgugggcugauucagacgcccuugcuuucaguggcgugauggucagcauggaggaaccugggugguacuccuuuggauucgaaaucaaggauaaaaagugcgacgugcccuguauagguauugagauggugcacgauggcgggaaagaaacauggcauucugccgcaacugccaucuauugccugaugggaagcggccaguugcuaugggacaccgucacagguguuaacauggcucuguga

SEQ ID NO: 151301 - RNA, 1401 nt, Artificial Sequence; identical to SEQ ID NO: 151270
  derived and/or modified sequence opt3 from neuraminidase__InfluenzaB__AGX17954

SEQ ID NO: 151302 - RNA, 1401 nt, Artificial Sequence
  derived and/or modified sequence opt3 from neuraminidase__InfluenzaB__AGX17976
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacaccccuccugccugaaccagaguggaccuaucccaggcugagcuguccugguaguacuuuccaaaaggcccucuuaaucuccccacaucgguuuggcgaaacaaaaggaaauucugcaccccugauuauccgcgagccuuucauugccugcgggccaaacgaauguaagcacuuugcucuuacccauuacgcagcccagccgggcgguuauuacaaugggacgcgaggagaccguaacaaauugagacaccugaucagcgugaagcuaggcaagauacccacugucgaaaauuccaucuuccauauggcugccuggucaggcagugcgugccacgaugggaaagaguggaccuauauuggaguggacgguccugauaacaaugcacuccugaagaucaaauacggcgaggccuacacagacacuuaucacagcuacgcuaacaauauucuuaggacccaggagucugccuguaacugcaucgggggaaauuguuaucugaugauaacagauggcuccgcaucagguguuagcgaaugccgguuuuugaagauucgcgaggggagaaucauuaaagagaucuucccaaccggaagggugaagcauacggaagaguguacuugcggcuuugcuaguaacaagacaaucgaaugugccugccgggacaauucuuacaccgcgaaacgccccuucgucaagcucaacguggagacugauacagccgaaauucgacugaugugcaccgacacguauuuagauaccccuagaccagacgauggcuccauaacagggcccugugagagcaacggagacaaagguucgggcgggaucaagggaggcuuuguacaccagaggauggcaucuaaaauuggucggugguacucccguacuaugucaaagaccgagcgcauggggaugggccuguauguuaaauacgacggagauccgugggcugacagugaugcccucgcuuucagcggcgugauggucuccaugaaggaaccugggugguacucuuuuggauucgagaucaaggacaaaaagugcgaugugcccuguauagguauugaaauggugcaugacggcgggaaagagacauggcacagcgccgcaacugccaucuauugccuuaugggaucaggccaacuguugugggauaccgucacagguguugacauggcucuauga

SEQ ID NO: 151303 - RNA, 1401 nt, Artificial Sequence
  derived and/or modified sequence opt3 from neuraminidase__InfluenzaB__AGX17987
augcugcccagcaccauccagacacucacucuuuuccugacguccggcgggguguuguuaucucuguacgucucaguuagucuaagcuaucuccuguacuccgacauucuucugaaguuuccuccaaccgagauaacagccccgacuaugcccuuggauugcgcuaacgcaucuaaugugcaagccguaaacagaucggcgaccaaaggagugacacuccugcugccugaaccagaguggaccuaucccaggcucucauguccugguagcacuuuccagaaggcuuuacugaucaguccacaccgguuuggcgaaacaaaaggaaauuccgcaccccuuauuauccgcgagccuuucauugccugcgggccaaaggaauguaaacauuuugccuugacccacuacgcugcacagccgggcgguuauuacaacgggacgcgaggagaccguaauaagcugagacaucuaaucucugucaagcucggcaaaauacccacuguggagaacagcaucuuccacauggccgcuugguccggcucagccugccaugaugggaaggaguggaccuauauuggaguugacgguccugauaauaacgcgcugcuuaaaaucaaguacggcgaagcauacacagacacuuaucacaguuacgccaauaacauucugaggacccaggagagcgcuuguaauugcaucgggggaaacuguuauuugaugauaacagauggcucugccuccggugugucagaaugccgguuucucaaaauucgcgaggggagaaucauuaaggagaucuucccaaccggaagggucaagcacacggaagaguguacuugcggcuuugcaagcaauaaaacaaucgaaugugcuugccgggacaacaguuacaccgccaagcgccccuucgugaaacugaauguagagacugauacagcggaaauucgauuaaugugcaccgagacguaucuggacaccccuagaccagaugacggcucuauaacagggcccugugaguccaacggagauaaggguagcggcgggaucaaaggaggcuuuguucaucaaaggauggccucgaagauuggucggugguacucucguacuauguccaaaaccaagcgcauggggaugggccucuaugugaaguacgacggagacccgugggcagauucagacgcucuugccuucaguggcgucauggugagcauggaggaaccugggugguacuccuuuggauucgaaaucaaagauaagaaaugcgacgugcccuguauagguauugagaugguccacgauggcgggaaggaaacauggcauucugcugccacugcaaucuauugccugaugggaagcggccaguugcuaugggacaccguuacaggugugaacauggcccuguga

SEQ ID NO: 151304 - RNA, 1401 nt, Artificial Sequence; identical to SEQ ID NO: 151277
  derived and/or modified sequence opt3 from neuraminidase__InfluenzaB__AGX17998

SEQ ID NO: 151305 - RNA, 1401 nt, Artificial Sequence; identical to SEQ ID NO: 151270
  derived and/or modified sequence opt3 from neuraminidase__InfluenzaB__AGX18009

SEQ ID NO: 151306 - RNA, 1401 nt, Artificial Sequence; identical to SEQ ID NO: 151303
  derived and/or modified sequence opt3 from neuraminidase__InfluenzaB__AGX18020

SEQ ID NO: 151307 - RNA, 1401 nt, Artificial Sequence; identical to SEQ ID NO: 151270
  derived and/or modified sequence opt3 from neuraminidase__InfluenzaB__AGX18031

SEQ ID NO: 151308 - RNA, 1401 nt, Artificial Sequence
  derived and/or modified sequence opt3 from neuraminidase__InfluenzaB__AGX18042
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguugaacugcgcaaaugccucgaacguucaagcggugaauagaucagcuaccaaaggaguaacacuccugcugcccgaaccugaguggaccuauccaaggcucagcugucccgguaguacuuuccagaaggccuuacugaucuccccucaccgguuuggcgaaacaaaagggaacucugcaccacuuauuauccgcgagcccuucauugccugcggaccuaaugaauguaagcauuuugcuuugacccacuacgcagcccagccaggcgguuauuacaacgggacgcgaggagaucguaauaaacugagacaucuaaucagcgugaagcucggcaagauaccgacugucgagaacuccaucuuccacauggcugccuggucaggcagugcgugccaugacgggaaagaguggaccuauauuggaguggauggucccgacaauaacgcacugcuuaagaucaaauacggcgaagccuacacagauacuuaucacagcuacgcuaauaacauucugaggacccaggagucugccuguaauugcaucgggggaaacuguuauuugaugauaacagacggcuccgcaucagguguuagcgaaugccgguuucucaagauucgcgaggggagaaucauuaaagagaucuucccuaccggaagggugaagcacacggaagaguguacuugcggcuuugcuaguaauaagacaaucgaaugugccugccgggauaacucuuacaccgcgaaacgcccauucgucaagcugaacguggagauugacacugccgaaauacgauuaaugugcacagauaccuaucuggacacgcccagaccugaugacggcuccaucaccgggccaugugagagcaauggagauaaagguucgggcgggauuaagggaggcuuuguacaucaaaggauggcaucuaaaaucggucggugguacucccguacaaugucaaagacugagcgcauggggaugggccucuauguuaaauacgacggagaccccugggcugauagugacgcccuugcuuucagcggcgugauggucuccaugaaggaaccggggugguacucuuuuggauucgagauaaaggauaaaaagugcgacgugccuuguauugguaucgaaauggugcacgauggcgggaaagagaccuggcauagcgccgcaacagccaucuauugccugaugggaucaggccaguugcuaugggacacugucaccgguguugauauggcucuguga

SEQ ID NO: 151309 - RNA, 1401 nt, Artificial Sequence; identical to SEQ ID NO: 151277
  derived and/or modified sequence opt3 from neuraminidase__InfluenzaB__AGX18053

SEQ ID NO: 151310 - RNA, 1401 nt, Artificial Sequence; identical to SEQ ID NO: 151277
  derived and/or modified sequence opt3 from neuraminidase__InfluenzaB__AGX18064

SEQ ID NO: 151311 - RNA, 1401 nt, Artificial Sequence
  derived and/or modified sequence opt3 from neuraminidase__InfluenzaB__AGX18075
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaagcucggcaaaauacccacugucgagaacagcaucuuccacauggcugccugguccggcucaaguugccaugaugggaaggaguggaccuauauuggaguggacgguccugauaauaacgcgcugcuuaaaaucaaguacggcgaagcauacacagacacuuaucacagcuacgccaauaacauucugaggacccaggagucugcuuguaauugcaucgggggaaacuguuauuugaugauaacagauggcuccgccucagguguuagcgaaugccgguuucucaaaauucgcgaggggagaaucauuaaggagaucuucccaaccggaagggugaagcacacggaagaguguacuugcggcuuugcaaguaauaaaacaaucgaaugugcuugccgggacaacucuuacaccgccaagcgccccuucgucaaacugaauguggagacugauacagcggaaauucgauuaaugugcaccgagacguaucuggacaccccuagaccagaugacggcuccauaacagggcccugugagagcaacggagauaaggguucgggcgggaucaaaggaggcuuuguacaucaaaggauggccucuaagauuggucggugguacucccguacuaugucaaaaaccaagcgcauggggaugggccucuauguuaaguacgacggagacccgugggcagauagugacgcucuugccuucagcggcgugauggucuccauggaggaaccugggugguacucuuuuggauucgaaaucaaagauaagaaaugcgacgugcccuguauagguauugagauggugcacgauggcgggaaggaaacauggcauagcgcugccacugcaaucuauugccugaugggaucaggccaguugcuaugggacaccgucacagguguuaacauggcccuguga

SEQ ID NO: 151312 - RNA, 1401 nt, Artificial Sequence; identical to SEQ ID NO: 150904
  derived and/or modified sequence opt3 from neuraminidase__InfluenzaB__AGX18086

SEQ ID NO: 151313 - RNA, 1401 nt, Artificial Sequence; identical to SEQ ID NO: 150904
  derived and/or modified sequence opt3 from neuraminidase__InfluenzaB__AGX18097

SEQ ID NO: 151314 - RNA, 1401 nt, Artificial Sequence; identical to SEQ ID NO: 150857
  derived and/or modified sequence opt3 from neuraminidase__InfluenzaB__AGX18108

SEQ ID NO: 151315 - RNA, 1401 nt, Artificial Sequence
  derived and/or modified sequence opt3 from neuraminidase__InfluenzaB__AGX18119
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacaccucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaacgaauguaagcauuuugccuugacgcacuacgcugcacagccaggcgguuauuacaaugggacucgaggagaccguaacaaacugagacaucuaaucagcgugaagcucggcaagauaccgaccgucgaaaauuccaucuuccacauggccgcuuggucaggcagugccugccaugaugggaaagaguggacauauauuggaguggacggucccgauaacaaugcgcugcuuaagaucaaauacggcgaggcauacacugacaccuaucacagcuacgccaacaauauucugaggacacaggagucugcuuguaacugcaucgggggaaauuguuauuugaugauaaccgauggcuccgccucagguguuagcgaaugccgguuucucaagauucgcgaggggagaaucauuaaagagaucuucccuacgggaagggugaagcacacugaagaguguacaugcggcuuugcaaguaacaagaccaucgaaugugcuugccgggacaauucuuacacugccaaacgcccauucgucaagcugaacauggagacagauaccgcggaaauuaaauuaaugugcacggacaccuaucuggauacaccccgaccugacgauggcuccauaacugggccaugugagagcaacggagacaaggguucgggcgggaucaaaggaggcuuugugcaucaaagaauggccucuaagauugguaggugguacucccggaccaugucaaaaacagagcguauggggaugggccucuauguaaaguacgacggagaucccugggcagacagugaugcucuugccuucagcggcguuaugguguccaugaaggaaccggggugguacucuuuuggauucgagaucaaagacaagaaaugcgaugucccuuguauagguauugaaauggugcacgacggcgggaaggagacuuggcauagcgcugccaccgcaaucuauugccugaugggaucaggccaguugcuaugggauacagugaccggugucgacauggcccuguga

SEQ ID NO: 151316 - RNA, 1401 nt, Artificial Sequence
  derived and/or modified sequence opt3 from neuraminidase__InfluenzaB__AGX18130
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagauugauacugccgaaauacgauuaaugugcacagacaccuaucuggauacgcccagaccugacgauggcuccaucaccgggccaugugagagcaacggagacaaagguucgggcgggauuaagggaggcuuuguacaucaaaggauggcaucuaaaaucggucggugguacucccguacaaugucacgcacugagagaauggggaugggccucuauguuaaguacgacggagaucccugggcugacagugaugcccuugcuuucagcggcgugauggucuccaugaaagaaccggggugguacucuuuuggauucgagauaaaggacaagaaaugcgaugugccuuguauugguaucgaaauggugcacgacggcgggaaggagaccuggcauagcgccgcaacagccaucuauugccugaugggaucaggccaguugcuaugggauacugucaccgguguugacauggcucuguga

SEQ ID NO: 151317 - RNA, 1401 nt, Artificial Sequence
  derived and/or modified sequence opt3 from neuraminidase__InfluenzaB__AGX18141
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaaugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcguaaagcucggcaaaauaccgacuguggagaacuccaucuuccacauggcugccuggucaggcagugcgugccaugaugggaaggaguggaccuauauuggagucgacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucaggugugagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucguuaaacugaauguggagacugauacagccgaaauacgauuaaugugcaccgagacguaucuggacacccccagaccugaugacggcuccaucacagggccaugugagagcaacggagauaaggguucgggcgggauuaaaggaggcuuuguccaucaaaggauggcaucuaagaucggucggugguacucccguacuaugucaaaaaccgaacgcauggggaugggccucuaugugaaguacgacggagaccccugggcugagagugaugcccuugcuuucagcggcguaaugguuuccauggaggaaccggggugguacucuuuuggauucgaaauaaaggacaaaaagugcgaugugccuuguauugguaucgagaugguccacgacggcgggaaagagacauggcauagcgccgcaacugccaucuauugccugaugggaucaggccaguugcuaugggauaccgugacaggugugaacauggcucuguga

SEQ ID NO: 151318 - RNA, 1401 nt, Artificial Sequence; identical to SEQ ID NO: 150904
  derived and/or modified sequence opt3 from neuraminidase__InfluenzaB__AGX18152

SEQ ID NO: 151319 - RNA, 1401 nt, Artificial Sequence
  derived and/or modified sequence opt3 from neuraminidase__InfluenzaB__AGX18163
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggaagcgaggagaccguaauaagcugagacaucuaaucagcgugaaacucggcaagauaccgacggucgagaacuccaucuuccacauggcugccuggucaggcagugcgugccaugaugggaaagaguggacuuauauuggaguggacggucccgauaauaacgcacugcuuaagaucaaauacggcgaagccuacaccgacacauaucacagcuacgcuaauaacauucugaggacucaggagucugccuguaauugcaucgggggaaacuguuauuugaugauaaccgauggcuccgcaucagguguuagcgaaugccgguuucucaagauucgcgaggggagaaucauuaaggagaucuucccuacaggaaggaucaaacacaccgaagaguguacgugcggcuuugcuaguaauaagacuauugaaugugccugccgggacaacucuuacacagcgaaacgcccauucgugaagcugaaugucgagaccgauacugccgaaauacgauuaaugugcacagagaccuaucuggacacgcccagaccugaugacggcuccaucaccgggccaugugagagcaacggagauaaagguucgggcgggauuaagggaggcuuugugcaucaaaggauggcaucuaaaaucggucggugguacucccguacaaugucaaagacugaacgcauggggaugggccucuauguaaaguacgacggagaccccugggcugauagugacgcccuugcuuucagcggcguuaugguguccauggaggaaccggggugguacucuuuuggauucgagauaaaagauaagaaaugcgacgucccuuguauugguaucgaaauggugcacgauggcgggaaggagaccuggcauagcgccgcaacagccaucuauugccugaugggaucaggccaguugcuaugggacacugugaccggugucaacauggcucuguga

SEQ ID NO: 151320 - RNA, 1401 nt, Artificial Sequence; identical to SEQ ID NO: 151270
  derived and/or modified sequence opt3 from neuraminidase__InfluenzaB__AGX18174

SEQ ID NO: 151321 - RNA, 1401 nt, Artificial Sequence; identical to SEQ ID NO: 150904
  derived and/or modified sequence opt3 from neuraminidase__InfluenzaB__AGX18185

SEQ ID NO: 151322 - RNA, 1401 nt, Artificial Sequence; identical to SEQ ID NO: 150857
  derived and/or modified sequence opt3 from neuraminidase__InfluenzaB__AGX18196

SEQ ID NO: 151323 - RNA, 1401 nt, Artificial Sequence
  derived and/or modified sequence opt3 from neuraminidase__InfluenzaB__AGX18207
augcugcccagcaccauccagacacucacucuuuuccugacguccggcgggguguuguuaucucuguacgucucagccagucuaagcuaucuccuguacuccgacauucuucugaaguuuccuccaaccgagauaacagcuccgacuaugcccuuggauugcgcaaacgccucuaauguucaagcggugaacagaucggcuaccaaaggaguaacacuccugcugccugaaccagaguggaccuaucccaggcucucauguccugguagcacuuuccagaaggccuuacugaucaguccacaccgguuuggcgaaacaaaaggaaauuccgcaccccuuauuauccgcgagccuuucauugccugcgggccaaaggaauguaaacauuuugcuuugacccacuacgcagcccagccgggcgguuauuacaacgggacgcgaggagaccguaauaagcugagacaucuaaucucugugaagcucggcaaaauacccacugucgagaccagcaucuuccacauggcugccugguccggcucagcgugccaugaugggaaggaguggacauauauuggaguggacgguccugauaacaaugcacugcuuaaaaucaaguacggcgaagccuacacugacaccuaucacaguuacgcuaacaauauucugaggacacaggagagcgccuguaacugcaucgggggaaauuguuauuugaugauaaccgauggcucugcauccgguguuucagaaugccgguuucucaaaauucgcgaggggagaaucauuaaggagaucuucccaacgggaagggugaagcacacugaagaguguacaugcggcuuugcuagcaacaaaaccaucgaaugugccugccgggacaauaguuacacugcgaagcgccccuucgucaaacugaacguggagacagauaccgccgaaauucgauuaaugugcacggagaccuaucuggacacaccuagaccagaugacggcucuauaacugggcccugugaguccaauggagauaaggguagcggcgggaucaaaggaggcuuuguacaucaaaggauggcaucgaagauuggucggugguacucucguaccauguccaaaacaaagcgcauggggaugggccucuauguuaaguacgacggagacccgugggcugauucagacgcccuugcuuucaguggcgugauggucagcauggaggaaccugggugguacuccuuuggauucgaaaucaaagauaagaaaugcgacgugcccuguauagguauugagauggugcacgauggcgggaaggaaacuuggcauucugccgcaaccgccaucuauugccugaugggaagcggccaguugcuaugggacacagucaccgguguuaacauggcucuguga

SEQ ID NO: 151324 - RNA, 1401 nt, Artificial Sequence
  derived and/or modified sequence opt3 from neuraminidase__InfluenzaB__AGX18218
augcugcccagcaccauccagacacucacucuuuuccugacguccggcgggguguuguuaucucuguacgucucagccagucuaagcuaucuccuguacuccgacauucuucugaaguugucuccuaccgagauaacagcuccaacuaugccgcucgauugcgcaaacaccucgaauguucaagccgugaacagaucagcgacaaaaggaguaacccugcugcuccccgaaccugaguggacuuauccaagguuaagcugucccgguaguacauuucagaaggcucugcuuaucuccccucaccgguucggcgaaaccaaaggaaauucugccccauugauuauccgcgagcccuuuauugcaugcgggccuaacgaauguaagcauuucgcccugacgcacuacgcugcacagccaggcgguuauuacaaucgaacucguggggacagaaacaaacuaaggcaucucaucagcgugaagcugggaaagauaccgaccgucgaaaauuccaucuuucacauggccgcuuggucaggcagugccugccaugauggcaaagaguggacauauauugggguggacggacccgauaacaaugcgcuucugaagaucaaauacggugaggcauacacugacaccuaucacagcuacgccaacaauauuuugcggacacaggagucugcuuguaacugcaucggcgggaauuguuaucucaugauaaccgauggauccgccucaggcguuagcgaaugccgcuuccugaagauuagagaggguaggaucauuaaagagaucuuuccuacggggcgggugaagcacacugaagaguguacaugcggauucgcaaguaacaagaccaucgaaugugcuugccgcgacaauucuuacacugccaaacgaccauuugucaaguuaaacauggagacagauaccgcggaaauuagacugaugugcacggacaccuaucucgauacacccaggccugacgauggcuccauaacuggcccaugugagagcaacggggacaaaggaucggguggcaucaaagggggauucgugcaucaacggauggccucuaagauuggccguugguacucccgcaccaugucaaagacagagagaauggguauggggcuuuauguaaaauacgacggcgaucccugggcagacagugaugcucuggccuuuagcggaguuaugguguccaugaaggaaccgggcugguacucuuucggguuugagaucaaggacaaaaagugcgaugucccuuguauaggaauugaaauggugcacgacgguggcaaagagacuuggcauagcgcugccaccgcaaucuauugcuugauggggucaggacagcuacugugggauacagugaccggcgucgacauggcccucuga

SEQ ID NO: 151325 - RNA, 1401 nt, Artificial Sequence; identical to SEQ ID NO: 151277
  derived and/or modified sequence opt3 from neuraminidase__InfluenzaB__AGX18229

SEQ ID NO: 151326 - RNA, 1401 nt, Artificial Sequence
  derived and/or modified sequence opt3 from neuraminidase__InfluenzaB__AGX18240
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaaaccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaacgaauguaagcauuuugccuugacgcacuacgcugcacagccaggcgguuauuacaaugggacucgaggagaccguaacaaacugagacaucuaaucagcgugaagcucggcaagauaccgaccgucgaaaauuccaucuuccacauggccgcuuggucaggcagugccugccaugaugggaaagaguggacauauauuggaguggacggucccgauaacaaugcgcugcuuaagaucaaauacggcgaggcauacacugacaccuaucacagcuacgccaacaauauucugaggacacaggagucugcuuguaacugcaucgggggaaauuguuauuugaugauaaccgauggcuccgccucagguguuagcgaaugccgguuucucaagauucgcgaggggagaaucauuaaagagaucuucccuacgggaagggugaagcacacugaagaguguacaugcggcuuugcaaguaacaagaccaucgaaugugcuugccgggacaauucuuacacugccaaacgcccauucgucaagcugaacguggagauugauacagcggaaauacgauuaaugugcaccgacacguaucuggauacccccagaccugacgauggcuccaucacagggccaugugagagcaacggagacaaagguucgggcgggauuaagggaggcuuuguacaucaaaggauggccucuaaaaucggucggugguacucccguacuaugucaaagaccgagcgcauggggaugggccucuauguuaaauacgacggagaucccugggcagacagugaugcucuugccuucagcggcgugauggucuccaugaaggaaccggggugguacucuuuuggauucgagauaaaggacaaaaagugcgaugugccuuguauugguaucgaaauggugcacgacggcgggaaagagacauggcauagcgcugccacugcaaucuauugccugaugggaucaggccaguugcuaugggauaccgucacagguguugacauggcccuguga

SEQ ID NO: 151327 - RNA, 1401 nt, Artificial Sequence; identical to SEQ ID NO: 151270
  derived and/or modified sequence opt3 from neuraminidase__InfluenzaB__AGX18251

SEQ ID NO: 151328 - RNA, 1401 nt, Artificial Sequence
  derived and/or modified sequence opt3 from neuraminidase__InfluenzaB__AGX18262
augcugcccagcaccauccagacacucacucuuuuccugacguccggcgggguguuguuaucucuguacgucucagccagucuaagcuaucuccuguacuccaacauucuucugaaguuuucuccuaccgagauaacagcuccaacuaugccguuggacugcgcaaaugccucgaacguucaagcggugaauagaucagcuaccaaaggaguaacacuccugcugcccgaaccugaguggaccuauccaaggcucagcugucccgguaguacuuuccagaaggccuuacugaucuccccucaccgguuuggcgaaacaaaagggaacucugcaccacuuauuauccgcgagcccuucauugccugcggaccuaaugaauguaagcauuuugcuuugacccacuacgcagcccagccaggcgguuauuacaacgggacgcgaggagaucguaauaaacugagacaucuaaucagcgugaagcucggcaagauaccgacugucgagaacuccaucuuccacauggcugccuggucaggcagugcgugccaugacgggaaagaguggaccuauauuggaguggauggucccgacaauaacgcacugcuuaagaucaaauacggcgaagccuacacagauacuuaucacagcuacgcuaauaacauucugaggacccaggagucugccuguaauugcaucgggggaaacuguuauuugaugauaacagacggcuccgcaucagguguuagcgaaugccgguuucucaagauucgcgaggggagaaucauuaaagagaucuucccuaccggaagggugaagcacacggaagaguguacuugcggcuuugcuaguaauaagacaaucgaaugugccugccgggauaacucuuacaccgcgaaacgcccauucgucaagcugaacguggagacugacacagccgaaauucgauuaaugugcaccgauacguaucuggacacccccagaccugaugacggcuccauaacagggccaugugagagcaauggagauaaagguucgggcgggaucaagggaggcuuuguacaucaaaggauggcaucuaaaguuggucggugguacucccguacuaugucaaagaccgagcgcauggggaugggccucuaugugaaauacgacggagaccccugggcugauagugacgcccuugcuuucagcggcgucaugguguccaugaaggaaccggggugguacucuuuuggauucgagauuaaggauaaaaagugcgacgugccuuguaucgguauagaaaugguccacgauggcgggaaagagacauggcauagcgccgcaacugccauuuauugccugaugggaucaggccaguugcuaugggacaccguuacagguguggauauggcucuguga

SEQ ID NO: 151329 - RNA, 1401 nt, Artificial Sequence; identical to SEQ ID NO: 151277
  derived and/or modified sequence opt3 from neuraminidase__InfluenzaB__AGX18273

SEQ ID NO: 151330 - RNA, 1401 nt, Artificial Sequence; identical to SEQ ID NO: 151302
  derived and/or modified sequence opt3 from neuraminidase__InfluenzaB__AGX18284

SEQ ID NO: 151331 - RNA, 1401 nt, Artificial Sequence; identical to SEQ ID NO: 151277
  derived and/or modified sequence opt3 from neuraminidase__InfluenzaB__AGX18295

SEQ ID NO: 151332 - RNA, 1401 nt, Artificial Sequence; identical to SEQ ID NO: 150904
  derived and/or modified sequence opt3 from neuraminidase__InfluenzaB__AGX18306

SEQ ID NO: 151333 - RNA, 1401 nt, Artificial Sequence
  derived and/or modified sequence opt3 from neuraminidase__InfluenzaB__AGX18317
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgagacgcgaggggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauaauaacgcacugcuuaaaaucaaguacggugaggccuacacagacacuuaucacagcuacgcuaauaacauucugaggacccaggaaucugccuguaauugcaucggcgggaacuguuauuugaugauaacagauggauccgcaucaggcguuagcgagugccgguuucucaaaauucgcgaggguagaaucauuaaggaaaucuucccuaccgggaggaucaagcacacggaggaauguacuugcggauuugcuaguaauaaaacaauugagugugccugccgggacaacucuuacaccgcgaagcgcccauucgugaaacugaaugucgaaacugauacagccgagauacgauuaaugugcaccgagacguaucuggacacccccagaccugaugacggcuccaucacaggcccaugugaaagcaacggggauaagggaucggguggcauuaaagggggauuugugcaucaaaggauggcaucuaagaucggccggugguacucccguacuaugucaaaaaccaagcgcauggguauggggcucuauguaaaguacgacggcgaccccugggcugauagugacgcccuugcuuucagcggaguuaugguguccauggaggaaccgggcugguacucuuuuggguucgagauaaaagauaagaaaugcgacgucccuuguauuggaaucgaaauggugcacgaugguggcaaggagacauggcauagcgccgcaacugccaucuauugccugauggggucaggacaguugcuaugggacaccgugacaggcgucaacauggcucuguga

SEQ ID NO: 151334 - RNA, 1401 nt, Artificial Sequence; identical to SEQ ID NO: 151277
  derived and/or modified sequence opt3 from neuraminidase__InfluenzaB__AGX18328

SEQ ID NO: 151335 - RNA, 1401 nt, Artificial Sequence
  derived and/or modified sequence opt3 from neuraminidase__InfluenzaB__AGX18339
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaucaaaggauggcaucuaaaguuggucggugguacucccguacuaugucaaagaccgagcgcauggggaugggccucuaugugaaauacgacggagaucccugggcugacagugaugcccuugcuuucggcggggucauggugagcaugaaggaaccgggaugguacuccuuugguuucgagauuaaggacaaaaagugcgaugugccuuguaucggcauagaaaugguccacgacgggggaaaagagacauggcauucugccgcaacugccauuuauugccugaugggcagcggucaguugcuaugggauaccguuacagggguggacauggcucuguga

SEQ ID NO: 151336 - RNA, 1401 nt, Artificial Sequence
  derived and/or modified sequence opt3 from neuraminidase__InfluenzaB__AGX18350
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcgaugaacagaucagcuaccaaaggagugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcguaaagcucggcaagauaccgacuguggaaaauuccaucuuccacauggcugccuggucaggcagugcgugccaugaugggaaagaguggaccuauauuggagucgacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucaggugugagcgaaugccgguuucucaagauucgcgaggggagaaucauuaaagagaucuucccuaccggaaggguuaagcacacggaagaguguacuugcggcuuugcuaguaacaagacaaucgaaugugccugccgggacaauucuuacaccgcgaaacgcccauucgugaagcugaacgucgagauugauacugccgaaauacgauuaaugugcacagacaccuaucuggauacgcccagaccugacgauggcuccaucaccgggccaugugagagcaacggagacaaagguucgggcgggauuaagggaggcuuugugcaucaaaggauggcaucuaaaaucggucggugguacucccguacaaugucaaagacugagcgcauggggaugggccucuauguaaaauacgacggagaucccugggcugacagugaugcccuugcuuucagcggcguuaugguguccaugaaggaaccggggugguacucuuuuggauucgagauaaaggacaaaaagugcgaugucccuuguauugguaucgaaauggugcacgacggcgggaaagagaccuggcauagcgccgcaacagccaucuauugccugaugggaucaggccaguugcuaugggauacugugaccggugucgacauggcucuguga

SEQ ID NO: 151337 - RNA, 1401 nt, Artificial Sequence; identical to SEQ ID NO: 151302
  derived and/or modified sequence opt3 from neuraminidase__InfluenzaB__AGX18361

SEQ ID NO: 151338 - RNA, 1401 nt, Artificial Sequence
  derived and/or modified sequence opt3 from neuraminidase__InfluenzaB__AGX18383
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacaccucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaacgaauguaagcauuuugccuugacgcacuacgcugcacagccaggcgguuauuacaaugggacucgaggagaccguaacaaacugagacaucuaaucagcgugaagcucggcaagauaccgaccgucgaaaauuccaucuuccacauggccgcuuggucaggcagugccugccaugaugggaaagaguggacauauauuggaguggacggucccgauaacaaugcgcugcuuaagaucaaauacggcgaggcauacacugacaccuaucacagcuacgccaacaauauucugaggacacaggagucugcuuguaacugcaucgggggaaauuguuauuugaugauaaccgauggcuccgccucagguguuagcgaaugccgguuucucaagauucgcgaggggagaaucauuaaagagaucuucccuacgggaagggugaagcacacugaagaguguacaugcggcuuugcaaguaacaagaccaucgaaugugcuugccgggacaauucuuacacugccaaacgcccauucgucaagcugaacauggagacagauaccgcggaaauucgauuaaugugcacggacaccuaucuggauacacccagaccugacgauggcuccauaacugggccaugugagagcaacggagacaaagguucgggcgggaucaagggaggcuuugugcaucaaaggauggccucuaaaauuggucggugguacucccguaccaugucaaagacagagcgcauggggaugggccucuauguaaaauacgacggagaucccugggcagacagugaugcucuuguuuucagcggcgugauggucuccaugaaggaaccggggugguacucuuuuggauucgagaucaaggacaaaaagugcgaugugccuuguauagguauugaaauggugcacggcgggggaaaagagacuuggcauagcgccgcuaccgccaucuauugccugaugggcucaggucaguugcuaugggacacagucaccgggguugauauggcacuguga

SEQ ID NO: 151339 - RNA, 1401 nt, Artificial Sequence; identical to SEQ ID NO: 150904
  derived and/or modified sequence opt3 from neuraminidase__InfluenzaB__AGX18394

SEQ ID NO: 151340 - RNA, 1401 nt, Artificial Sequence
  derived and/or modified sequence opt3 from neuraminidase__InfluenzaB__AGX18405
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacaccccuccugccugaaccagaguggaccuaucccaggcugagcuguccugguaguacuuuccaaaaggcccucuuaaucuccccacaucgguuuggcgaaacaaaaggaaauucugcaccccugauuauccgcgagccuuucauugccugcgggccaaacgaauguaagcacuuugcucuuacccauuacgcagcccagccgggcgguuauuacaaugggacgcgaggagaccguaacaaauugagacaccugaucagcgugaagcuaggcaagauacccacugucgaaaauuccaucuuccauauggcugccuggucaggcagugcgugccacgaugggaaagaguggaccuauauuggaguggacgguccugauaacaaugcacuccugaagaucaaauacggcgaggccuacacagacacuuaucacagcuacgcuaacaauauucuuaggacccaggagucugccuguaacugcaucgggggaaauuguuaucugaugauaacagauggcuccgcaucagguguuagcgaaugccgguuuuugaagauucgcgaggggagaaucauuaaagagaucuucccaaccggaagggugaagcauacggaagaguguacuugcggcuuugcuaguaacaagacaaucgaaugugucugccgggacaauucuuacaccgccaaacgccccuucgugaagcucaacguagagacugauacagcggaaauucgacugaugugcaccgacacguauuuagauaccccuagaccagacgauggcuccauaacagggcccugugagagcaacggagacaaagguucgggcgggaucaagggaggcuuuguucaccagaggauggccucuaaaauuggucggugguacucccguacuaugucaaagaccgagcgcauggggaugggccuguaugugaaauacgacggagauccgugggcagacagugaugcucucgccuucagcggcgucaugguguccaugaaggaaccugggugguacucuuuuggauucgagaucaaggacaaaaagugcgaugugcccuguauagguauugaaaugguccaugacggcgggaaagagacauggcacagcgcugccacugcaaucuauugccuuaugggaucaggccaacuguugugggauaccguuacagguguggacauggcccuauga

SEQ ID NO: 151341 - RNA, 1401 nt, Artificial Sequence
  derived and/or modified sequence opt3 from neuraminidase__InfluenzaB__AGX18416
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagauugauacugccgaaauacgauuaaugugcacagacaccuaucuggauacgcccagaccugacgauggcuccaucaccgggagcugugagucgaacggagacaaagguucuggcgggauuaagggaggcuuuguacaucaaaggauggcauccaaaaucggucggugguacucacguacaaugaguaagacugagcgcauggggaugggccucuauguuaaauacgacggagauccaugggcugacagcgaugcccuugcuuucuccggcgugauggucucuaugaaggaacccgggugguacagcuuuggauucgagauaaaggacaaaaagugcgaugugccguguauugguaucgaaauggugcacgacggcgggaaagagaccuggcauucagccgcaacagccaucuauugccugaugggaaguggccaguugcuaugggauacugucaccgguguugacauggcucuguga

SEQ ID NO: 151342 - RNA, 1401 nt, Artificial Sequence
  derived and/or modified sequence opt3 from neuraminidase__InfluenzaB__AGX18428
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaccaaaggaaauuccgcaccucuuauuauccgcgagccauucauugccugcgggcccaaggaauguaaacauuuugcuuugacgcacuacgcagcccagccuggcgguuauuacaacgggacucgagaggaccguaauaagcugagacaucuaaucagcgugaagcucggaaaaauaccaaccgucgagaacuccaucuuccacauggcugccuggucaggcagugcgugccaugauggcaaggaauggacauauauugggguggacggaccggauagcaaugcacugcuuaaaaucaaguacggugaggccuacacugacaccuaucacucuuacgcuaacaauauucugaggacacaggaauccgccuguaacugcaucggcgggaauuguuauuugaugauaaccgauggaucagcaagcggcauuagugagugccgguuucucaaaauccgcgaggguagaauuaucaaggaaaucuuccccacggggaggguuaagcacacugaggaauguacaugcggauuugcuucuaacaaaaccauugagugugccugccgggacaauuccuacacugcgaagcgcccuuucgugaaacugaacgucgaaacagauaccgccgagauacgauuaaugugcacggagaccuaucuggacacaccaagacccgaugacggcagcaucacuggcccuugugaaucgaaugggaacaagggaucugguggcauuaaagggggauuugugcaucaaaggauggcauccaagaucggccggugguacucacguaccaugaguaaaacaaagcgcauggguauggggcucuauguaaaguacgauggcgacccauggauagacagcgaugcucuugcccuguccggaguuauggugucuauggaggaacccggcugguacagcuucggguuugagauuaaagacaagaaaugcgaugucccguguaucggaaucgaaauggugcacgacgguggcaaggagacuuggcauucagcugccaccgcaauuuauugcuugauggggaguggacagcuacugugggauacagugaccggcgucgacauggcccucuga

SEQ ID NO: 151343 - RNA, 1401 nt, Artificial Sequence
  derived and/or modified sequence opt3 from neuraminidase__InfluenzaB__AGX18439
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagauugauacugccgaaauacgauuaaugugcacagacaccuaucuggauacgcccagaccugacgauggcuccaucaccgggccaugugagagcaacggagacaaagguucgggcgggauuaagggaggcuuuguacaucaaaggauggcaucuaaaaucggucggugguacucccguacaaugucaaagacugagcgcauggggaugggccucuauguuaaauacgacggagaucccugggcugacagugaugcccuugcuuucagcggccugaugguguccaugaaggaaccggggugguacucuuuuggauucgagauaaaggacaaaaagugcgaugucccuuguauugguaucgaaauggugcacgacggcgggaaagagaccuggcauagcgccgcaacagccaucuauugcuugaugggaucaggccagcuacugugggauacugugaccggugucgacauggcucucuga

SEQ ID NO: 151344 - RNA, 1401 nt, Artificial Sequence
  derived and/or modified sequence opt3 from neuraminidase__InfluenzaB__AGX18450
augcugcccagcaccauccagacacucacucuuuuccugacguccggcgggguguuguuaucucuguacgucucagccagucuaagcuaucuccuguacuccgacauucuucugaaguuuucuccuaccgagauaacagcuucgacuaugccauuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuaacaauauucugaggacccaggaguccgccuguaacugcaucgggggaaauuguuauuugaugauaacagauggcucagcaagcgguguuagugaaugccgguuucucaagauucgcgaggggagaaucauuaaagagaucuuccccaccggaagggugaagcacacggaagaguguacuugcggcuuugcuucuaacaagacaaucgaaugugccugccgggacaauuccuacaccgcgaaacgcccuuucgucaagcugaacguggagauugauacugccgaaauacgauuaaugugcacagacaccuaucuggauacgccaagacccgacgauggcagcaucaccgggccuugugagucgaacggagacaaagguucuggcgggauuaagggaggcuuuguacaucaaaggauggcauccaaaaucggucggugguacucacguacaaugaguaagacugagcgcauggggaugggccucuauguuaaauacgacggagauccaugggcugacagcgaugcccuugcuuucuccggcgugauggucucuaugaaggaacccgggugguacagcuuuggauucgagauaaaggacaaaaagugcgaugugccguguauugguaucgaaauggugcacgacggcgggaaagagaccuggcauucagccgcaacagccaucuauugccugaugggaaguggccaguugcuaugggauacugucaccgguguugacauggcucuguga

SEQ ID NO: 151345 - RNA, 1401 nt, Artificial Sequence; identical to SEQ ID NO: 150904
  derived and/or modified sequence opt3 from neuraminidase__InfluenzaB__AGX18461

SEQ ID NO: 151346 - RNA, 1401 nt, Artificial Sequence
  derived and/or modified sequence opt3 from neuraminidase__InfluenzaB__AGX18472
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaaccauucagcuaccaaaggaguaacaccccuccugccugaaccagaguggaccuaucccagacugagcuguccugguaguacuuuccaaaaggcccucuuaaucuccccacacagguuuggcgaaacaaaaggaaauucugcaccccugauuauccgggagccuuucauugccugcgggccaaacgaauguaagcauuuugcucuuacccacuacgcagcccagccgggcgguuauuacaaugggacgcgcggagaccgaaacaaauugcgucaucugaucagcgugaagcuaggcaagauacccacugucgaaaauuccaucuuccacauggcugccuggucaggcagugcgugccacgaugggaaagaguggaccuauauuggaguggacgguccugauaacaaugcacuccugaagaucaaauacggcgaggccuacacagacacuuaucauagcuacgcuaacaauauucuuagaacccaggagucugccuguaacugcaucgggggaaauuguuaucugaugauaacagauggcuccgcaucagguguuagcgaaugcagguuuuugaagauucgggaggggcgcaucauuaaagagaucuucccaaccggaagagugaagcacacggaagaguguacuugcggcuuugcuaguaacaagacaaucgaaugugccugcagggacaauucuuacaccgcgaaacggcccuucgucaagcucaacguggagacugauacagccgaaauucgccugaugugcaccgacacguauuuagauaccccucgaccagacgauggcuccauaacagggcccugugagagcaacggagacaaagguucgggcgggaucaagggaggcuuuguacaucagagaauggcaucuaaaauugguaggugguacucccggacuaugucaaagaccgagcguauggggaugggccuguauguuaaauacgacggagauccgugggcugacagugaugcccucgcuuucagcggcgugauggucuccaugaaggaaccugggugguacucuuuuggauucgagaucaaggacaaaaagugcgaugugcccuguauagguauugaaauggugcacgacggcgggaaagagacauggcacagcgccgcaacugccaucuauugccuuaugggaucaggccaacuguugugggauaccgucacagguguugacauggcucuauga

SEQ ID NO: 151347 - RNA, 1401 nt, Artificial Sequence; identical to SEQ ID NO: 150904
  derived and/or modified sequence opt3 from neuraminidase__InfluenzaB__AGX18483

SEQ ID NO: 151348 - RNA, 1401 nt, Artificial Sequence; identical to SEQ ID NO: 150651
  derived and/or modified sequence opt3 from neuraminidase__InfluenzaB__AGX18494

SEQ ID NO: 151349 - RNA, 1401 nt, Artificial Sequence
  derived and/or modified sequence opt3 from neuraminidase__InfluenzaB__AGX18505
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacaaggguucgggcgggaucaaaggaggcuuuguacaucaaaggauggcaucuaagauuggucggugguacucccguacuaucucaaaaaccgagcgcauggggaugggccucuauguuaaguacgacggagaucccugggcugacagugaugcccuugcuuucagcggcgugauggucuccaugaaggaaccggggugguacucuuuuggauucgagauaaaagacaagaaaugcgaugugccuuguauugguaucgaaauggugcacgacggcgggaaggagacauggcauagcgccgcaacugccaucuauugccugaugggaucaggccaguugcuaugggauaccgucacagguguugacauggcucuguga

SEQ ID NO: 151350 - RNA, 1401 nt, Artificial Sequence
  derived and/or modified sequence opt3 from neuraminidase__InfluenzaB__AGX18516
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacaaggguucgggcgggaucaaaggaggcuuuguacaucaaaggauggcaucuaagauuggucggugguacucccguacuaucucaaaaaccgagcgcauggggaugggccucuauguuaaguacgacggagaucccugggcugacagugaugcccuugcuuucagcggcgugauggucuccaugaaggaaccggggugguacucuuuuggauucgagauaaaagacaagaaaugcgaugugccuuguauugguaucgaaauggugcacggcgggggaaaggagacauggcauagcgccgcaacugccaucuauugccugaugggcucaggucaguugcuaugggacaccgucacagggguugauauggcucuguga

SEQ ID NO: 151351 - RNA, 1401 nt, Artificial Sequence; identical to SEQ ID NO: 150651
  derived and/or modified sequence opt3 from neuraminidase__InfluenzaB__AGX18527

SEQ ID NO: 151352 - RNA, 1401 nt, Artificial Sequence; identical to SEQ ID NO: 150651
  derived and/or modified sequence opt3 from neuraminidase__InfluenzaB__AGX18538

SEQ ID NO: 151353 - RNA, 1401 nt, Artificial Sequence; identical to SEQ ID NO: 150651
  derived and/or modified sequence opt3 from neuraminidase__InfluenzaB__AGX18549

SEQ ID NO: 151354 - RNA, 1401 nt, Artificial Sequence; identical to SEQ ID NO: 150651
  derived and/or modified sequence opt3 from neuraminidase__InfluenzaB__AGX18560

SEQ ID NO: 151355 - RNA, 1401 nt, Artificial Sequence; identical to SEQ ID NO: 150651
  derived and/or modified sequence opt3 from neuraminidase__InfluenzaB__AGX18571

SEQ ID NO: 151356 - RNA, 1401 nt, Artificial Sequence
  derived and/or modified sequence opt3 from neuraminidase__InfluenzaB__AGX18582
augcugcccagcaccauccagacacucacucuuuuccugacguccggcgggguguuguuaucucuguacguccuagccucacucaguuaucugcuuuacagcgacauucuguugaaguuuuccccuaccgagauaacagcuccaacuaugccgcucgauugcgcaaacgccucuaauguucacgcggugaacagaucggcuaccaaaggaguaacacugcugcuccccgaaccugagugggccuauccaagguuaucaugucccgguagcaccuuccaaaaggcacugcuuaucaguccucaucgguuuggcgaaacuaaaggaaauuccgccccauugauuauccgcgagcccuucauugcuugcgggccuaacgaauguaagcacuuugcacugacacauuacgccgcucagccaggcgguuauuacaaugggacccgaggagaccguaacaaacuaagacaccucaucucugugaagcugggcaagauaccgacggucgagaauagcaucuuccauauggccgcgugguccggcucagcaugccacgaugggaaagaguggacuuauauuggaguggacggucccgauaacaaugcccuucugaagaucaaauacggcgaggcuuacaccgacacauaucacaguuacgccaacaauauuuugaggacucaggaaagcgcauguaacugcaucgggggaaauuguuaucucaugauaaccgauggcucugcuuccgguguuucagaaugccgguuucugaagauucgcgaggggagaaucauuaaagagaucuucccuacaggaagggugaagcauaccgaagaguguacgugcggcuuugccagcaacaagacuaucgaaugugcgugccgggacaauaguuacacagccaaacgcccauucgucaaguuaaacguggagaccgauacugcagaaauucgacugaugugcacagacaccuaucucgauacgcccagaccugacgauggcucuauaaccgggccaugugaguccaacggagacaaagguagcggcgggaucaagggaggcuuuguacaccagaggauggcuucgaaaauuggucggugguacucucguacaauguccaagacugagcgcauggggaugggccuuuauguuaaauacgacggagaucccugggccgacucagaugcucuggccuucaguggcgugauggucagcaugaaggaaccggggugguacuccuuuggauucgagaucaaggacaaaaagugcgaugugccuuguauagguauugaaauggugcaugacggcgggaaagagaccuggcacucugcagccacagcuaucuauugcuugaugggaagcggccaacuacugugggauacugucaccgguguugacauggcgcucuga

SEQ ID NO: 151357 - RNA, 1401 nt, Artificial Sequence; identical to SEQ ID NO: 150651
  derived and/or modified sequence opt3 from neuraminidase__InfluenzaB__AGX18593

SEQ ID NO: 151358 - RNA, 1401 nt, Artificial Sequence; identical to SEQ ID NO: 150651
  derived and/or modified sequence opt3 from neuraminidase__InfluenzaB__AGX18604

SEQ ID NO: 151359 - RNA, 1401 nt, Artificial Sequence
  derived and/or modified sequence opt3 from neuraminidase__InfluenzaB__AGX18615
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggaaacaaggguucgggcgggaucaaaggaggcuuuguacaucaaaggauggcaucuaagauuggucggugguacucccguacuaugucaaaaaccgagcgcauggggaugggccucuauguuaaguacgacggagaccccugggcugauagugacgcccuugcuuucagcggcgugauggucuccaugaaggaaccggggugguacucuuuuggauucgagaucaaagauaagaaaugcgacgugccuuguauagguauugaaauggugcacgauggcgggaaggagacauggcauagcgccgcaacugccaucuauugccugaugggaucaggccaguugcuaugggacaccgucacagguguugauauggcucuguga

SEQ ID NO: 151360 - RNA, 1401 nt, Artificial Sequence
  derived and/or modified sequence opt3 from neuraminidase__InfluenzaB__AGX18626
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuuugcgcgagcccuucaucgccugcgggccuaacgaauguaagcauuuugcucugacccacuacgcagcccagccaggcgguuauuacaaugggacgcgaggagaccguaacaaacuaagacaucucauuagcgugaagcugggcaagaucccgacugucgaaaauuccauauuccacauggcugccuggucaggcagugcgugccaugaugggaaagaguggaccuauaucggaguggacggucccgauaacaaugcacuucugaagauuaaauacggcgaggccuacacagacacuuaucacagcuacgcuaacaagaucuugaggacccaggagucugccuguaauugcauugggggaaacuguuaucucaugaucacagauggcuccgcaucagguguuagcgaaugccgguuucugaaaauacgcgaggggagaauuaucaaggagauuuucccuaccggaagggugaagcacacggaagaguguacuugcggcuuugcuaguaauaaaacaaucgaaugugccugccgggacaacucuuacaccgcgaagcgcccauucgucaaauuaaauguggagacugauacagccgaaauccgacugaugugcaccgacacguaucucgauacccccagaccugacgauggcuccauuacagggccaugugagagcaacggagacaaggguucgggcgggauaaaaggaggcuuuguacaucaaaggauggcaucuaagaucggucggugguacucccguacuaugucaaaaaccgagcgcauggggaugggccuuuauguuaaguacgacggagaucccugggcugacagugaugcccuggcuuucagcggcgugauggucuccaugaaggaaccggggugguacucuuuuggauucgagauuaaagacaagaaaugcgaugugccuuguaucgguauagaaauggugcacgacggcgggaaggagacauggcauagcgccgcaacugccauuuauugcuugaugggaucaggccagcuacugugggauaccgucacagguguugacauggcucucuga

SEQ ID NO: 151361 - RNA, 1401 nt, Artificial Sequence; identical to SEQ ID NO: 150651
  derived and/or modified sequence opt3 from neuraminidase__InfluenzaB__AGX18637

SEQ ID NO: 151362 - RNA, 1401 nt, Artificial Sequence; identical to SEQ ID NO: 150651
  derived and/or modified sequence opt3 from neuraminidase__InfluenzaB__AGX18648

SEQ ID NO: 151363 - RNA, 1401 nt, Artificial Sequence; identical to SEQ ID NO: 150651
  derived and/or modified sequence opt3 from neuraminidase__InfluenzaB__AGX18659

SEQ ID NO: 151364 - RNA, 1401 nt, Artificial Sequence; identical to SEQ ID NO: 150651
  derived and/or modified sequence opt3 from neuraminidase__InfluenzaB__AGX18670

SEQ ID NO: 151365 - RNA, 1401 nt, Artificial Sequence
  derived and/or modified sequence opt3 from neuraminidase__InfluenzaB__AGX18681
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauugugcgcgagcccuucaucgccugcgggccuaacgaauguaagcauuuugcuuugacccacuacgcagcccagccaggcgguuauuacaaugggacgcgaggagaccguaacaaacugagacaucuaauuagcgucaagcucggcaagaucccgacuguggaaaauuccauauuccacauggcugccuggucaggcagugcgugccaugaugggaaagaguggaccuauaucggaguugacggucccgauaacaaugcacugcuuaagauuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguucgggcgggauaaaaggaggcuuuguucaucaaaggauggcaucuaagaucggucggugguacucccguacuaugucaaaaaccgagcgcauggggaugggccucuaugugaaguacgacggagaucccugggcugacagugaugcccuugcuuucagcggcgucaugguguccaugaaggaaccggggugguacucuuuuggauucgagauuaaagacaagaaaugcgaugugccuuguaucgguauagaaaugguccacgacggcgggaaggagacauggcauagcgccgcaacugccauuuauugccugaugggaucaggccaguugcuaugggauaccguuacagguguggacauggcucuguga

SEQ ID NO: 151366 - RNA, 1401 nt, Artificial Sequence; identical to SEQ ID NO: 150651
  derived and/or modified sequence opt3 from neuraminidase__InfluenzaB__AGX18692

SEQ ID NO: 151367 - RNA, 1401 nt, Artificial Sequence
  derived and/or modified sequence opt3 from neuraminidase__InfluenzaB__AGX18703
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaaccucucagcuaccaaaggaguaacacugcugcuccccgaaccugaguggaccuauccaagauuaagcugucccgguaguacuuuccagaaggcccugcuuaucuccccucacagguuuggcgaaacaaaaggaaauucugcaccauugauuauccgggagcccuucauugccugcgggccuaaggaauguaaacauuuugcucugacccacuacgcagcccagccaggcgguuauuacaacgggacgcgcggagaccgaaauaagcuacgucaucucaucagcgugaagcugggcaaaauaccgacugucgagaacuccaucuuccacauggcugccuggucaggcagugcgugccaugaugggaaggaguggaccuauauuggaguggacggucccgauaauaacgcacuucugaaaaucaaguacggcgaagccuacacagacacuuaucacagcuacgcuaauaacauuuugagaacccaggagucugccuguaauugcaucgggggaaacuguuaucucaugauaacagauggcuccgcaucagguguuagcgaaugcagguuucugaaaauucgggaggggcgcaucauuaaggagaucuucccuaccggaagaaucaagcacacggaagaguguacuugcggcuuugcuaguaauaaaacaauugaaugugccugcagggacaacucuuacaccgcgaagcggccauucgugaaauuaaaugucgagacugauacagccgaaauacgccugaugugcaccgagacguaucucgacacaccccgaccugaugacggcuccaucaccgggccaugugagagcaacggagauaaggguucgggcgggauuaaaggaggcuuugugcaucaaagaauggcaucuaagaucgguaggugguacucccggacuaugucaaaaaccgaacguauggggaugggccuuuauguaaaguacgacggagaccccugggcugauagugacgcccuggcuuucagcggcguuaugguguccauggaggaaccggggugguacucuuuuggauucgagauaaaggauaaaaagugcgacgucccuuguauugguaucgaaauggugcacgauggcgggaaagagacauggcauagcgccgcaacugccaucuauugcuugaugggaucaggccagcuacugugggacaccgugacaggugucaacauggcucucuga

SEQ ID NO: 151368 - RNA, 1401 nt, Artificial Sequence; identical to SEQ ID NO: 150651
  derived and/or modified sequence opt3 from neuraminidase__InfluenzaB__AGX18714

SEQ ID NO: 151369 - RNA, 1401 nt, Artificial Sequence; identical to SEQ ID NO: 150651
  derived and/or modified sequence opt3 from neuraminidase__InfluenzaB__AGX18725

SEQ ID NO: 151370 - RNA, 1401 nt, Artificial Sequence
  derived and/or modified sequence opt3 from neuraminidase__InfluenzaB__AGX18736
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgggaggcgaccgaaacaaacugcgucaucuaaucagcgugaagcucggcaagauaccgacugucgaaaauuccaucuuccacauggcugccuggucagggagugcgugccaugauggaaaagaguggaccuauauugguguggacggccccgauaacaaugcacugcuuaagaucaaauacggggaggccuacacagacacuuaucacagcuacgcuaacaagauucugagaacccaggagucugccuguaauugcaucggaggcaacuguuauuugaugauaacagaugguuccgcaucagggguuagcgaaugcagguuucucaaaauucgggagggacgcaucauuaaggagaucuucccuaccggcagagugaagcacacggaagaguguacuugcggcuuugcuaguaauaaaacaaucgaaugugccugcagggacaacucuuacaccgcgaagcggccauucgucaaacugaauguggagacugauacagccgaaauucgcuuaaugugcaccgacacguaucuggauacaccccgaccugacgauggguccauaaccggaccaugugagagcaacggugacaagggcucugggggaaucaaaggcgguuuuguacaucaaagaauggcaucgaagauugggaggugguacucccggacuaugucaaaaaccgagcguaugggcaugggacucuauguuaaguacgacggcgaucccugggcugacagugaugcccuugcuuucagcggggugauggucuccaugaaggaaccgggaugguacucuuuugguuucgagaucaaagacaagaaaugcgaugugccuuguauaggcauugaaauggugcacgacgggggaaaggagacauggcauagcgccgcaacugccaucuauugccugaugggcucaggucaguugcuaugggauaccgucacagggguugacauggcucuguga

SEQ ID NO: 151371 - RNA, 1401 nt, Artificial Sequence; identical to SEQ ID NO: 150651
  derived and/or modified sequence opt3 from neuraminidase__InfluenzaB__AGX18758

SEQ ID NO: 151372 - RNA, 1401 nt, Artificial Sequence; identical to SEQ ID NO: 150651
  derived and/or modified sequence opt3 from neuraminidase__InfluenzaB__AGX18769

SEQ ID NO: 151373 - RNA, 1401 nt, Artificial Sequence; identical to SEQ ID NO: 151110
  derived and/or modified sequence opt3 from neuraminidase__InfluenzaB__AGX18780

SEQ ID NO: 151374 - RNA, 1401 nt, Artificial Sequence; identical to SEQ ID NO: 150651
  derived and/or modified sequence opt3 from neuraminidase__InfluenzaB__AGX18791

SEQ ID NO: 151375 - RNA, 1401 nt, Artificial Sequence; identical to SEQ ID NO: 150651
  derived and/or modified sequence opt3 from neuraminidase__InfluenzaB__AGX18802

SEQ ID NO: 151376 - RNA, 1401 nt, Artificial Sequence
  derived and/or modified sequence opt3 from neuraminidase__InfluenzaB__AGX18813
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccgaacgcauggggaugggccucuauguaaaguacgacggagaccccugggcugauagugacgcccuuguuuucagcggcgugauggucuccauggaggaaccggggugguacucuuuuggauucgagauaaaggauaaaaagugcgacgugccuuguauugguaucgaaauggugcacgauggcgggaaagagacauggcauagcgcugccacugcaaucuauugccugaugggaucaggccaguugcuaugggacaccgucacagguguuaacauggcccuguga

SEQ ID NO: 151377 - RNA, 1401 nt, Artificial Sequence; identical to SEQ ID NO: 151110
  derived and/or modified sequence opt3 from neuraminidase__InfluenzaB__AGX18824

SEQ ID NO: 151378 - RNA, 1401 nt, Artificial Sequence
  derived and/or modified sequence opt3 from neuraminidase__InfluenzaB__AGX18846
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugagcgaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuaacaagauucugaggacccaggaguccgccuguaauugcaucgggggaaacuguuauuugaugauaacagauggcucagcaagcgguguuagugaaugccgguuucucaaaauucgcgaggggagaaucauuaaggagaucuuccccaccggaagggugaagcacacggaagaguguacuugcggcuuugcuucuaauaaaacaaucgaaugugccugccgggacaacuccuacaccgcgaagcgcccuuucgucaaacugaauguggagacugauacagccgaaauucgauuaaugugcaccgacacguaucuggauaccccaagacccgacgauggcagcauaacagggccuugugagucgaacggagacaaggguucuggcgggaucaaaggaggcuuuguacaucaaaggauggcauccaagauuggucggugguacucacguacuaugaguaaaaccgagcgcauggggaugggccucuauguuaaguacgacggagauccaugggcugacagcgaugcccuugcuuucuccggcgugauggucucuaugaaggaacccgggugguacagcuuuggauucgagaucaaagacaagaaaugcgaugugccguguauagguauugaaauggugcacgacggcgggaaggagacauggcauucagccgcaacugccaucuauugccugaugggaaguggccaguugcuaugggauaccgucacagguguugacauggcucuguga

SEQ ID NO: 151379 - RNA, 1401 nt, Artificial Sequence; identical to SEQ ID NO: 150651
  derived and/or modified sequence opt3 from neuraminidase__InfluenzaB__AGX18857

SEQ ID NO: 151380 - RNA, 1401 nt, Artificial Sequence; identical to SEQ ID NO: 151378
  derived and/or modified sequence opt3 from neuraminidase__InfluenzaB__AGX18868

SEQ ID NO: 151381 - RNA, 1401 nt, Artificial Sequence; identical to SEQ ID NO: 151378
  derived and/or modified sequence opt3 from neuraminidase__InfluenzaB__AGX18879

SEQ ID NO: 151382 - RNA, 1401 nt, Artificial Sequence
  derived and/or modified sequence opt3 from neuraminidase__InfluenzaB__AGX18890
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccgaacgcauggggaugggccucuauguaaaguacgacggagaccccugggcugauagugacgcccuugcuuucagcggcguuaugguguccauggaggaaccggggugguacucuuuuggauucgagauaaaggauaaaaagugcgacgucccuuguauugguaucgaaauggugcacgauggcgggaaagagacauggcauagcgccgcaacuaccaucuauugccugaugggaucaggccaguugcuaugggacacagugaccggugucaacauggcccuguga

SEQ ID NO: 151383 - RNA, 1401 nt, Artificial Sequence; identical to SEQ ID NO: 150651
  derived and/or modified sequence opt3 from neuraminidase__InfluenzaB__AGX18912

SEQ ID NO: 151384 - RNA, 1401 nt, Artificial Sequence
  derived and/or modified sequence opt3 from neuraminidase__InfluenzaB__AGX18923
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaucgaacgcguggggacagaaacaaacugaggcaucuaaucagcgugaagcucggaaagauaccgacugucgaaaauuccaucuuccacauggcugccuggucaggcagugcgugccaugauggcaaagaguggauuuauaucgggguggacggacccgauaacaaugcacugcuuaagauuaaauacggugaggccuacaccgacacauaucacagcuacgcuaacaagauccugcggacucaggagucugccuguaauugcauaggcgggaacuguuauuugaugauuaccgauggauccgcaucaggcguuagcgaaugccgcuuucucaaaaucagagaggguaggauuaucaaggagaucuucccuacagggcgggugaagcacaccgaagaguguacgugcggauuugcuaguaauaaaacuauugaaugugccugccgcgacaacucuuacacagcgaagcgaccauucgucaaacugaauguggagaccgauacugccgaaauaagauuaaugugcacagacaccuaucuggauacgcccaggccugacgauggcuccaucaccggcccaugugagagcaacggggacaagggaucggguggcauuaaagggggauuuguacaucaacggauggcaucuaagaucggccguugguacucccgcacaaugucaaaaacugagagaauggguauggggcucuauguuaaguacgacggcgaucccugggcugacagugaugcccuugcuuucagcggagugauggucuccaugaaggaaccgggcugguacucuuuuggguucgagauaaaagacaagaaaugcgaugugccuuguauuggaaucgaaauggugcacgacgguggcaaggagaccuggcauagcgccgcaacagccaucuauugccugauggggucaggacaguugcuaugggauacugucaccggcguugacauggcucuguga

SEQ ID NO: 151385 - RNA, 1401 nt, Artificial Sequence; identical to SEQ ID NO: 150651
  derived and/or modified sequence opt3 from neuraminidase__InfluenzaB__AGX18934

SEQ ID NO: 151386 - RNA, 1401 nt, Artificial Sequence
  derived and/or modified sequence opt3 from neuraminidase__InfluenzaB__AGX18956
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacguggcugccuggucaggcagugcgugccaugaugggaaagaguggaccuauauuggaguugacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucaggugugagcgaaugccgguuucucaaaauucgcgaggggagaaucauuaaggagaucuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauucgauuaaugugcaccgacacguaucuggauacccccagaccugacgauggcuccauaacagggccaugugagagcaacggagacaaggguucgggcgggaucaaaggaggcuuuguucaucaaaggauggcaucuaagauuggucggugguacucccguacuaugucaaaaaccgagcgcauggggaugggccucuaugugaaguacgacggagaucccugggcugacagugaugcccuugcuuucagcggcgucaugguguccaugaaggaaccggggugguacucuuuuggauucgagaucaaagacaagaaaugcgaugugccuuguauagguauugaaaugguccacgacggcgggaaggagacauggcauagcgccgcaacugccaucuauugccugaugggaucaggccaguugcuaugggauaccguuacagguguggacauggcucuguga

SEQ ID NO: 151387 - RNA, 1401 nt, Artificial Sequence
  derived and/or modified sequence opt3 from neuraminidase__InfluenzaB__AGX18967
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacaccccuccugccugaaccagaguggaccuaucccaggcugagcuguccugguaguacuuuccagaaggcccucuuaaucuccccacaccgguuuggcgaaacaaaaggaaauucugcaccccugauuauccgcgagccuuucauugccugcgggccaaacgaauguaagcauuuugcucuuacccacuacgcagcccagccgggcgguuauuacaaugggacgcgaggagaccguaacaaauugagacaucugaucagcgugaagcuaggcaagauacccacugucgaaaauuccaucuuccacauggcugccuggucaggcagugcgugccaugaugggaaagaguggaccuauauuggaguggacgguccugauaacaaugcacuccugaagaucaaauacggcgaggccuacacagacacuuaucacagcuacgcuaacaagauucuuaggacccaggagucugccuguaauugcaucgggggaaacuguuaucugaugauaacagauggcuccgcaucagguguuagcgaaugccgguuuuugaaaauucgcgaggggagaaucauuaaggagaucuucccaaccggaagggugaagcacacggaagaguguacuugcggcuuugcuaguaauaaaacaaucgaaugugccugccgggacaacucuuacaccgcgaagcgccccuucgucaaacucaauguggagacugauacagccgaaauucgacugaugugcaccgacacguauuuagauaccccuagaccagacgauggcuccauaacagggcccugugagagcaacggagacaaggguucgggcgggaucaaaggaggcuuuguacaucaaaggauggcaucuaagauuggucggugguacucccguacuaugucaaaaaccgagcgcauggggaugggccuguauguuaaguacgacggagauccgugggcugacagugaugcccucgcuuucagcggcgugauggucuccaugaaggaaccugggugguacucuuuuggauucgagaucaaagacaagaaaugcgaugugcccuguauagguauugaaauggugcacgacggcgggaaggagacauggcauagcgccgcaacugccaucuauugccuuaugggaucaggccagcuguugugggauaccgucacagguguugacauggcucuauga

SEQ ID NO: 151388 - RNA, 1401 nt, Artificial Sequence; identical to SEQ ID NO: 151110
  derived and/or modified sequence opt3 from neuraminidase__InfluenzaB__AGX18978

SEQ ID NO: 151389 - RNA, 1401 nt, Artificial Sequence
  derived and/or modified sequence opt3 from neuraminidase__InfluenzaB__AGX18989
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauuaugcaaacgccucgaauguucaagcggugaacagaucagcuaccaaaggaguaacacuccugcugcccgaaccugaguggaccuacccaaggcucagcugccccgguaguacuuuccagaaggccuuacugaucuccccucaccgguuuggcgaaacaaaaggaaauucugcaccacuuauuauccgcgagcccuucauugccugugggccuaacgaaugcaagcauuuugcuuugacccacuaugcagcccagccaggcgguuacuauaaugggacgcgaggagaccguaacaaacugagacaucuaaucagcgugaagcucggcaagauaccgacugucgaaaauuccaucuuccacauggcugccuggucaggcagugcgugucaugaugggaaagaguggaccuacauuggaguggacggucccgauaacaaugcacugcuuaagaucaaauacggcgaggccuauacagacacuuaccacagcuaugcuaacaagauucugaggacccaggagucugccugcaauuguaucgggggaaacugcuacuugaugauaacagauggcuccgcaucagguguuagcgaaugucgguuucucaaaauucgcgaggggagaaucaccaaggagauuuucccuacgggaagggugaagcacacugaagagugcacauguggcuuugcuaguaauaaaaccaucgaaugcgccugucgggacaacucuuauacugcgaagcgcccauucgucaaacugaauguggagacagauaccgccgaaauccgauuaaugugcacggacaccuaccuggauacacccagaccugacgauggcuccauuacugggccaugcgagagcaacggagacaaggguucgggcgggauaaaaggaggcuuuguacaucaaaggauggcaucuaagaucggucggugguauucccguaccaugucaaaaacagagcgcauggggaugggccucuacguuaaguacgacggagaucccugggcugacagugaugcccuugcuuucagcggcgugauggucuccaugaaggaaccggggugguauucuuuuggauucgagauuaaagacaagaaaugugaugugccuugcaucgguauagaaauggugcacgacggcgggaaggagacuuggcauagcgccgcaaccgccauuuacugucugaugggaucaggccaguugcuaugggauacagucaccgguguugacauggcucuguga

SEQ ID NO: 151390 - RNA, 1401 nt, Artificial Sequence
  derived and/or modified sequence opt3 from neuraminidase__InfluenzaB__AGX19000
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugaccuacuaugcagcccagccaggcgguuacuauaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuacauuggaguggacggucccgauaacaaugcacugcuuaagaucaaauacggcgaggccuauacagacacuuaccacagcuaugcuaacaauauucugaggacccaggagucugccuguaacugcaucgggggaaauuguuacuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuauaccgcgaaacgcccauucgucaagcugaacguggagacugauacagccgaaauucgauuaaugugcaccgacacguaccuggauacccccagaccugacgauggcuccauaacagggccaugugagagcaacggagacaaagguucgggcgggaucaagggaggcuuuguacaucagaggauggcaucuaaaauuggucggugguauucccguacuaugucaaagaccgagcgcauggggaugggccucuacguuaaauacgacggagaucccugggcugacagugaugcccuugcuuucagcggcgugauggucuccaugaaggaaccggggugguauucuuuuggauucgagaucaaggacaaaaagugcgaugugccuuguauagguauugaaauggugcacgacggcgggaaagagacauggcauagcgccgcaacugccaucuacugccugaugggaucaggccaauugcuaugggauaccgucacagguguugacauggcucuguga

SEQ ID NO: 151391 - RNA, 1401 nt, Artificial Sequence; identical to SEQ ID NO: 150651
  derived and/or modified sequence opt3 from neuraminidase__InfluenzaB__AGX19011

SEQ ID NO: 151392 - RNA, 1401 nt, Artificial Sequence; identical to SEQ ID NO: 150651
  derived and/or modified sequence opt3 from neuraminidase__InfluenzaB__AGX19022

SEQ ID NO: 151393 - RNA, 1401 nt, Artificial Sequence
  derived and/or modified sequence opt3 from neuraminidase__InfluenzaB__AGX19033
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguugaacugcgcaaaugccucgaacguucaagcggugaauagaucagcuaccaaaggaguaacacuccugcugcccgaaccugaguggaccuauccaaggcucagcugucccgguaguacuuuccagaaggccuuacugaucuccccucaccgguuuggcgaaacaaaagggaacucugcaccacuuauuauccgcgagcccuucauugccugcggaccuaaggaauguaaacauuuugcuuugacccacuacgcagcccagccaggcgguuauuacaaugggacgcgaggagaucguaacaagcugagacaucuaaucagcgugaagcucggcaaaauaccgacugucgaaaauuccaucuuccacauggcugccuggucaggcagugcgugccaugacgggaaggaguggaccuauauuggaguggauggucccgacaacaaugcacugcuuaaaaucaaguacggcgaagccuacacagauacuuaucacagcuacgcuaacaauauucugaggacccaggagucugccuguaacugcaucgggggaaauuguuauuugaugauaacagacggcuccgcaucagguguuagcgaaugccgguuucucaaaauucgcgaggggagaaucauuaaggagaucuucccuaccggaaggaucaagcacacggaagaguguacuugcggcuuugcuaguaacaaaacaauugaaugugccugccgggauaauucuuacaccgcgaagcgcccauucgugaaacugaacgucgagacugacacagccgaaauacgauuaaugugcaccgagacguaucuggauacccccagaccugacgauggcuccaucacagggccaugugagagcaacggagacaaggguucggaaggcauuaaagggggauuugugcaucaaaggauggcaucuaagaucggccggugguacucccguacuaugucaaaaaccgagcgcauggguauggggcucuauguaaaguacgauggcgaccccugggcugacagugaugcccuugcuuucagcggaguuaugguguccauggaggagccgggcugguacucuuuuggguucgaaauaaaggacaaaaagugcgaugucccuuguauuggaaucgagauggugcacgacgguggcaaagagacauggcauagcgccgcaacugccaucuauugccugauggggucaggacaguugcuaugggauaccgugacaggcgucaauauggcucuguga

SEQ ID NO: 151394 - RNA, 1401 nt, Artificial Sequence; identical to SEQ ID NO: 150651
  derived and/or modified sequence opt3 from neuraminidase__InfluenzaB__AGX19044

SEQ ID NO: 151395 - RNA, 1401 nt, Artificial Sequence; identical to SEQ ID NO: 150651
  derived and/or modified sequence opt3 from neuraminidase__InfluenzaB__AGX19055

SEQ ID NO: 151396 - RNA, 1401 nt, Artificial Sequence
  derived and/or modified sequence opt3 from neuraminidase__InfluenzaB__AGX19066
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggauuuauaucggaguggacggucccgauaacaaugcacugcuuaagauuaaauacggcgaggccuacaccgacacauaucacagcuacgcuaacaagauccugaggacucaggagucugccuguaauugcauagggggaaacuguuauuugaugauuaccgauggcuccgcaucagguguuagcgaaugccgguuucucaaaauccgcgaggggagaauuaucaaggagaucuucccuacaggaagggugaagcacaccgaagaguguacgugcggcuuugcuaguaauaaaacuauugaaugugccugccgggacaacucuuacacagcgaagcgcccauucgucaaacugaauguggagaccgauacugccgaaauacgauuaaugugcacagacaccuaucuggauacgcccagaccugacgauggcuccaucaccgggccaugugagagcaacggagacaaggguucgggcgggauuaaaggaggcuuuguacaucaaaggauggcaucuaagaucggucggugguacucccguacaaugucaaaaacugagcgcauggggaugggccucuauguuaaguacgacggagaucccugggcugacagugaugcccuugcuuucagcggcgugauggucuccaugaaggaaccggggugguacucuuuuggauucgagauaaaagacaagaaaugcgaugugccuuguauugguaucgaaauggugcacgacggcgggaaggagaccuggcauagcgccgcaacagccaucuauugccugaugggaucaggccaguugcuaugggauacugucaccgguguugacauggcucuguga

SEQ ID NO: 151397 - RNA, 1401 nt, Artificial Sequence
  derived and/or modified sequence opt3 from neuraminidase__InfluenzaB__AGX19077
augcugcccagcaccauccagacacucacucuuuuccugacguccggcgggguguuguuaucucuguacgucucagccagucuaagcuaucuccuguacuccgacauucuucugaaguuuaccccuacagagauaacugcuccaaccaugccguuggauugcgcaaacgccucuaauguucaagcggugaacagaucggcuacaaaaggaguaacuccccuccugccugaaccagaguggaccuaucccaggcugucauguccugguagcacauuccagaaggcccucuuaaucaguccacaccgguuuggcgaaaccaaaggaaauuccgcaccccugauuauccgcgagccuuucauugccugcgggccaaacgaauguaagcauuuugcucuuacgcacuacgcagcccagccgggcgguuauuacaaugggacucgaggagaccguaacaaauugagacaucugaucucugugaagcuaggcaagauacccaccgucgagaauagcaucuuccacauggcugccugguccggcucagcgugccaugaugggaaagaguggacauauauuggaguggacgguccugauaacaaugcacuccugaagaucaaauacggcgaagccuacacugacaccuaucacaguuacgcuaacaagauucuuaggacacaggagagcgccuguaauugcaucgggggaaacuguuaucugaugauaaccgauggcucugcauccgguguuucagaaugccgguuuuugaaaauucgcgaggggagaaucauuaaggagaucuucccaacgggaagggugaagcacacugaagaguguacaugcggcuuugcuagcaauaaaaccaucgaaugugccugccgggacaacaguuacacugcgaagcgccccuucgucaaacucaauguggagacagauaccgccgaaauucgacugaugugcacggacaccuauuuagauacaccuagaccagacgauggcucuauaacugggcccugugaguccaacggagacaaggguagcggcgggaucaaaggaggcuuuguacaucaaaggauggcaucgaagauuggucggugguacucucguaccauguccaaaacagagcgcauggggaugggccuguauguuaaguacgacggagauccgugggcugacucagaugcccucgcuuucaguggcgugauggucagcaugaaggaaccugggugguacuccuuuggauucgagaucaaagacaagaaaugcgaugugcccuguauagguauugaaauggugcacgacggcgggaaggagacuuggcauucugccgcaaccgccaucuauugccuuaugggaagcggccagcuguugugggauacagucaccgguguugacauggcucuauga

SEQ ID NO: 151398 - RNA, 1401 nt, Artificial Sequence
  derived and/or modified sequence opt3 from neuraminidase__InfluenzaB__AGX19088
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucgugaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguucgggcgggauaaaaggaggcuuuguucaucaaaggauggcaucuaagaucggucggugguacucccguacuaugucaaaaaccgagcgcauggggaugggccucuaugugaaguacgacggagaucccugggcugacagugaugcccuugcuuucagcggcgucaugguguccaugaaggaaccggggugguacucuuuuggauucgagauuaaagacaagaaaugcgaugugccuuguaucgguauagaaaugguccacgacggcgggaaggagacauggcauagcgccgcaacugccauuuauugccugaugggaucaggccaguugcuaugggauaccguuacagguguggacauggcucuguga

SEQ ID NO: 151399 - RNA, 1401 nt, Artificial Sequence; identical to SEQ ID NO: 150651
  derived and/or modified sequence opt3 from neuraminidase__InfluenzaB__AGX19099

SEQ ID NO: 151400 - RNA, 1401 nt, Artificial Sequence
  derived and/or modified sequence opt3 from neuraminidase__InfluenzaB__AGX19110
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggaucaagcacacggaagaguguacuugcggcuuugcuaguaauaaaacaauugaaugugccugccgggacaacucuuacaccgcgaagcgcccauucauaaaacugaauguggagacugauacagccgaaauccgauuaaugugcaccgagacguaucuggacacccccagaccugaugacggcuccauuacagggccaugugagagcaacggagauaaggguucgggcgggaucaaaggaggcuuuguccaucaaaggauggcaucuaagauaggucggugguacucccguacuaugucaaaaaccgaacgcauggggaugggccucuaugugaaguacgacggagaccccugggcugauagugacgcccuuguauucagcggcguuaugguguccauggaggaaccggggugguacucuuuuggauucgagauuaaggauaaaaagugcgacgucccuuguaucgguaucgaaauggugcacgauggcgggaaagagacauggcauagcgcugccacugcaauuuauugccugaugggaucaggccaguugcuaugggacaccgugacaggugucaacauggcccuguga

SEQ ID NO: 151401 - RNA, 1401 nt, Artificial Sequence
  derived and/or modified sequence opt3 from neuraminidase__InfluenzaB__AGX19121
augcugcccagcaccacacagacucucacgcuuuuccugaccuccggcgggguguuguuaucucuguacgucucagccagucuaagcuaucuccuguacuccgacauccuucugaaguuuucuccuacagagauuacugcuccaaccaugccguuggauugcgcaaacgccucgaauguucaagcggugaacagaucagcuacaaaaggaguaacccuccugcugcccgaaccugaguggacuuauccaaggcucagcugucccgguaguacauuccagaaggccuuacugauauccccucaccgguuuggcgaaaccaaaggaaauucugcaccacuuaucauucgcgagcccuucaucgccugcgggccuaacgaauguaagcauuuugcuuugacgcacuacgcagcccagccaggcgguuauuacaaugggacucgaggagaccguaacaaacugagacaucuaauuagcgugaagcucggcaagaucccgaccgucgaaaauuccauauuccacauggcugccuggucaggcagugcgugccaugaugggaaagaguggacauauaucggaguggacggucccgauaacaaugcacugcuuaagauuaaauacggcgaggccuacacugacaccuaucacagcuacgcuaacaagauccugaggacacaggagucugccuguaauugcauugggggaaacuguuauuugaugaucaccgauggcuccgcaucagguguuagcgaaugccgguuucucaaaauacgcgaggggagaauuaucaaggagauuuucccuacgggaagggugaagcacacugaagaguguacaugcggcuuugcuaguaauaaaaccaucgaaugugccugccgggacaacucuuacacugcgaagcgcccauucgucaaacugaauguggagacagauaccgccgaaauccgauuaaugugcacggacaccuaucuggauacacccagaccugacgauggcuccauuacugggccaugugagagcaacggagacaaggguucgggcgggauaaaaggaggcuuuguacaucaaaggauggcaucuaagaucggucggugguacucccguaccaugucaaaaacagagcgcauggggaugggccucuauguuaaguacgacggagaucccugggcugacagugaugcccuugcuuucagaggcgugauggucagcaugaaggaaccggggugguacuccuuuggauucgagauuaaagacaagaaaugcgaugugccuuguaucgguauagaaauggugcacgacggcgggaaggagacuuggcauucugccgcaaccgccauuuauugccugaugggaagcggccaguugcuaugggauacagucaccgguguugacauggcucuguga

SEQ ID NO: 151402 - RNA, 1401 nt, Artificial Sequence; identical to SEQ ID NO: 151285
  derived and/or modified sequence opt3 from neuraminidase__InfluenzaB__AGX19132

SEQ ID NO: 151403 - RNA, 1401 nt, Artificial Sequence; identical to SEQ ID NO: 151389
  derived and/or modified sequence opt3 from neuraminidase__InfluenzaB__AGX19143

SEQ ID NO: 151404 - RNA, 1401 nt, Artificial Sequence
  derived and/or modified sequence opt3 from neuraminidase__InfluenzaB__AGX19154
augcugcccagcaccauccagacacucacucuuuuccugacguccggcgggguguuguuaucucuguacgucucagccagucuaagcuaucuccuguacuccaacauucuucugaaguuuucuccuaccgagauaacagcuccaacuaugccguuggacugcgcaaaugccucgaacguucacgcggugaauagaucagcuaccaaaggaguaacacuccugcugcccgaaccugaguggaccuauccaaggcucagcugucccgguaguacuuuccaaaaggccuuacugaucuccccucaucgguuuggcgaaacaaaagggaacucugcaccacuuauuauccgcgagcccuucauugccugcggaccuaaugaauguaagcacuuugcuuugacccauuacgcagcccagccaggcgguuauuacaacgggacgcgaggagaucguaauaaacugagacaccuaaucagcgugaagcucggcaagauaccgacugucgagaacuccaucuuccauauggcugccuggucaggcagugcgugccacgacgggaaagaguggaccuauauuggaguggauggucccgacaauaacgcacugcuuaagaucaaauacggcgaagccuacacagauacuuaucacagcuacgcuaauaacauucugaggacccaggagucugccuguaauugcaucgggggaaacuguuauuugaugauaacagacggcuccgcaucagguguuagcgaaugccgguuucucaagauucgcgaggggagaaucauuaaagagaucuucccuaccggaagggugaagcauacggaagaguguacuugcggcuuugcuaguaauaagacaaucgaaugugccugccgggauaacucuuacaccgcgaaacgcccauucgucaagcugaacguggagacugacacagccgaaauucgauuaaugugcaccgauacguaucuggacacccccagaccugaugacggcuccauaacagggccaugugagagcaauggagauaaagguucgggcgggaucaagggaggcuuuguacaccagaggauggcaucuaaaauuggucggugguacucccguacuaugucaaagaccgagcgcauggggaugggccucuauguuaaauacgacggagaccccugggcugauagugacgcccuugcuuucagcggcgugauggucuccaugaaggaaccggggugguacucuuuuggauucgagaucaaggauaaaaagugcgacgugccuuguauagguauugaaauggugcaugauggcgggaaagagacauggcacagcgccgcaacugccaucuauugccugaugggaucaggccaauugcuaugggacaccgucacagguguugauauggcucuguga

SEQ ID NO: 151405 - RNA, 1401 nt, Artificial Sequence; identical to SEQ ID NO: 150651
  derived and/or modified sequence opt3 from neuraminidase__InfluenzaB__AGX19165

SEQ ID NO: 151406 - RNA, 1401 nt, Artificial Sequence
  derived and/or modified sequence opt3 from neuraminidase__InfluenzaB__AGX19176
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaucgaacgcguggggacagaaacaaacugaggcaccuaaucagcgugaagcucggaaagauaccgacugucgaaaauuccaucuuccauauggcugccuggucaggcagugcgugccacgauggcaaagaguggaccuauauugggguggacggacccgauaacaaugcacugcuuaagaucaaauacggugaggccuacacagacacuuaucacagcuacgcuaacaauauucugcggacccaggagucugccuguaacugcaucggcgggaauuguuauuugaugauaacagauggauccgcaucaggcguuagcgaaugccgcuuucucaagauuagagaggguaggaucauuaaagagaucuucccuaccgggcgggugaagcauacggaagaguguacuugcggauuugcuaguaacaagacaaucgaaugugccugccgcgacaauucuuacaccgcgaaacgaccauucgucaagcugaacguggagacugauacagccgaaauuagauuaaugugcaccgacacguaucuggauacccccaggccugacgauggcuccauaacaggcccaugugagagcaacggggacaaaggaucggguggcaucaaagggggauuuguacaccagcggauggcaucuaagauuggccguugguacucccgcacuaugucaaagaccgagagaauggguauggggcucuauguuaaauacgacggcgaucccugggcugacagugaugcccuugcuuucagcggagugauggucuccaugaaggaaccgggcugguacucuuuuggguucgagaucaaggacaaaaagugcgaugugccuuguauaggaauugaaauggugcaugacgguggcaaagagacauggcacagcgccgcaacugccaucuauugccugauggggucaggacaauugcuaugggauaccgucacaggcguugacauggcucuguga

SEQ ID NO: 151407 - RNA, 1401 nt, Artificial Sequence
  derived and/or modified sequence opt3 from neuraminidase__InfluenzaB__AGX19187
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcuguagugguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuaacaagauucugaggacccaggaguccgccuguaauugcaucgggggaaacuguuauuugaugauaacagauggcucagcaagcgguguuagugaaugccgguuucucaaaauucgcgaggggagaaucauuaaggagaucuuccccaccggaagggugaagcacacggaagaguguacuugcggcuuugcuucuaauaaaacaaucgaaugugccugccgggacaacuccuacaccgcgaagcgcccuuucgucaaacugaauguggagacugauacagccgaaauucgauuaaugugcaccgacacguaucuggauaccccaagacccgacgauggcagcauaacagggccuugugagucgaacggagacaaggguucuggcgggaucaaaggaggcuuuguacaucaaaggauggcauccaagauuggucggugguacucacguacuaugaguaaaaccgagcgcauggggaugggccucuauguuaaguacgacggagauccaugggcugacagcgaugcccuugcuuucuccggcgugauggucucuaugaaggaacccgggugguacagcuuuggauucgagaucaaagacaagaaaugcgaugugccguguauagguauugaaauggugcacgacggcgggaaggagacauggcauucagccgcaacugccaucuauugccugaugggaaguggccaguugcuaugggauaccgucacagguguugacauggcucuguga

SEQ ID NO: 151408 - RNA, 1401 nt, Artificial Sequence
  derived and/or modified sequence opt3 from neuraminidase__InfluenzaB__AGX19198
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauuaugcaaacgccucgaauguucaagcggugaacagaucagcuaccaaaggaguaacacuccugcugcccgaaccugaguggaccuacccaaggcucagcugccccgguaguacuuuccagaaggccuuacugaucuccccucaccgguuuggcgaaacaaaaggaaauucugcaccacuuauuauccgcgagcccuucauugccugugggccuaacgaaugcaagcauuuugcuuugacccacuaugcagcccagccaggcgguuacuauaaugggacgcgaggagaccguaacaaacugagacaucuaaucagcgugaagcucggcaagauaccgacugucgaaaauuccaucuuccacauggcugccuggucaggcagugcgugucaugaugggaaagaguggaccuacauuggaguggacggucccgauaacaaugcacugcuuaagaucaaauacggcgaggccuauacagacacuuaccacagcuaugcuaacaagauucugaggacccaggagucugccugcaauuguaucgggggaaacugcuacuugaugauaacagauggcuccgcaucagguguuagcgaaugucgguuucucaaaauucgcgaggggagaaucauuaaggagaucuucccuaccggaagggugaagcacacggaagagugcacuuguggcuuugcuaguaauaaaacaaucgaaugcgccugucgggacaacucuuauaccgcgaagcgcccauucgucaaacugaauguggagacugauacagccgaaauucgauuaaugugcaccgacacguaccuggauacccccagaccugacgauggcuccauaacagggccaugcgagagcaacggagacaaggguucgggcgggaucaaaggaggcuuuguacaucaaaggauggcaucuaagauuggucggugguauucccguacuaugucaaaaaccgagcgcauggggaugggccucuacguuaaguacgacggagaucccugggcugacagugaugcccuugcuuucagcggcgugauggucuccaugaaggaaccggggugguauucuuuuggauucgagaucaaagacaagaaaugugaugugccuugcauagguauugaaauggugcacgacggcgggaaggagacauggcauagcgccgcaacugccaucuacugucugaugggaucaggccaguugcuaugggauaccgucacagguguugacauggcucuguga

SEQ ID NO: 151409 - RNA, 1401 nt, Artificial Sequence; identical to SEQ ID NO: 151389
  derived and/or modified sequence opt3 from neuraminidase__InfluenzaB__AGX19209

SEQ ID NO: 151410 - RNA, 1401 nt, Artificial Sequence
  derived and/or modified sequence opt3 from neuraminidase__InfluenzaB__AGX19220
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagaucaaauacggcgaggccuacacagacacuuaucacucuuacgcuaacaagauucugaggacccaggaguccgccuguaauugcaucgggggaaacuguuauuugaugauaacagauggcucagcaagcgguguuagugaaugccgguuucucaaaauucgcgaggggagaaucauuaaggagaucuuccccaccggaagggugaagcacacggaagaguguacuugcggcuuugcuucuaauaaaacaaucgaaugugccugccgggacaacuccuacaccgcgaagcgcccuuucgucaaacugaauguggagacugauacagccgaaauucgauuaaugugcaccgacacguaucuggauaccccaagacccgacgauggcagcauaacagggccuugugagucgaacggagacagggguucuggcgggaucaagggaggcuuuguacaucaacggauggcauccaaaauuggucguugguacucacgcacuaugaguaagaccgagagaauggggaugggccucuauguuaaauacgacggagauccaugggcugacagcgaugcccuugcuuucuccggcgugauggucucuaugaaggaacccgggugguacagcuuuggauucgagaucaaggacaaaaagugcgaugugccguguauagguauugaaauggugcacgacggcgggaaagagacauggcauucagccgcaacugccaucuauugccugaugggaaguggccaguugcuaugggauaccgucacagguguugacauggcucuguga

SEQ ID NO: 151411 - RNA, 1401 nt, Artificial Sequence; identical to SEQ ID NO: 150857
  derived and/or modified sequence opt3 from neuraminidase__InfluenzaB__AGX19231

SEQ ID NO: 151412 - RNA, 1401 nt, Artificial Sequence
  derived and/or modified sequence opt3 from neuraminidase__InfluenzaB__AGX19253
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaacgaauguaagcacuuugcuuugacccauuacgcagcccagccaggcgguuauuacaaugggacgcgcggagaccgaaacaaacugcgucaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaagauucugagaacccaggagucugccuguaauugcaucgggggaaacuguuauuugaugauaacagauggcuccgcaucagguguuagcgaaugcagguuucucaaaauucgggaggggcgcaucauuaaggagaucuucccuaccggaagagugaagcauacggaagaguguacuugcggcuuugcuaguaauaaaacaaucgaaugugccugcagggacaacucuuacaccgcgaagcggccauucgucaaacugaauguggagacugauacagccgaaauucgcuuaaugugcaccgacacguaucuggauacaccccgaccugacgauggcuccauaaccgggccaugugagagcaacggagacaaggguucgggcgggaucaaaggaggcuuuguacaccaaagaauggcaucuaagauugguaggugguacucccggacuaugucaaaaaccgagcguauggggaugggccucuauguuaaguacgacggagaucccugggcugacagugauagccuugccuucuccggcgugauggucucuaugaaggaaccggggugguacagcuuuggauucgagaucaaagacaagaaaugcgaugugccuuguauagguauugaaauggugcaugacggcgggaaggagacauggcacucagcugccacugcaaucuauugccugaugggaaguggccaguugcuaugggauaccgucacagguguugacauggcccuguga

SEQ ID NO: 151413 - RNA, 1401 nt, Artificial Sequence; identical to SEQ ID NO: 151387
  derived and/or modified sequence opt3 from neuraminidase__InfluenzaB__AGX19264

SEQ ID NO: 151414 - RNA, 1401 nt, Artificial Sequence; identical to SEQ ID NO: 150651
  derived and/or modified sequence opt3 from neuraminidase__InfluenzaB__AGX19275

SEQ ID NO: 151415 - RNA, 1401 nt, Artificial Sequence
  derived and/or modified sequence opt3 from neuraminidase__InfluenzaB__AGX19286
augauccccagcaccauucagacacugacucucuuccuuacguccggcggggugcuguugucuuuauacgucucagccagucugagcuaucuacucuacuccgacauacugcuuaaguuuucuccuaccgagaucauugcuccaacaaugccgcuggauugcgcaaacgccucgaauguucacgcggugaacagaucagcuacuaaaggaguaaccuugcuccugcccgaaccugaguggacauauccaaggcugagcugucccgguaguaccuuccaaaaggcccucuuaaucuccccucaucgguuuggcgaaacuaaaggaaauucugcaccacugauuauccgcgagcccuucauagccugcgggccuaacgaauguaagcacuuugcucuuacacauuacgcagcccagccaggcgguuauuacaaugggacccgaggagaccguaacaaauugagacaccugaucagcgugaagcuaggcaagauuccgacggucgaaaauuccaucuuccauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauacuuaggacucaggagucugccuguaacugcauugggggaaauuguuaucugaugaucaccgauggcuccgcaucagguguuagcgaaugccgguuuuugaagauucgcgaggggagaaucaucaaagagauuuucccuacaggaagggugaagcauaccgaagaguguacgugcggcuuugcuaguaacaagacuauagaaugugccugccgggacaauucuuacacagcgaaacgcccauucgucaagcucaacguggagaccgauacugccgaaauccgacugaugugcacagacaccuauuuagauacgcccagaccugacgauggcuccauuaccgggccaugugagagcaacggagacaaagguucgggcgggaucaagggaggcuuuguacaccagaggauggcaucuaaaauaggucggugguacucccguacaaugucaaagacugagcgcauggggaugggccuguauguuaaauacgacggagaucccugggcugacagugaugcccucgcuuucagcggcgugauggucuccaugaaggaaccggggugguacucuuuuggauucgagauuaaggacaaaaagugcgaugugccuuguaucgguaucgaaauggugcaugacggcgggaaagagaccuggcacagcgccgcaacagccauuuauugccuuaugggaucaggccaacuguugugggauacugucaccgguguugacauggcucuauga

SEQ ID NO: 151416 - RNA, 1401 nt, Artificial Sequence
  derived and/or modified sequence opt3 from neuraminidase__InfluenzaB__AGX19297
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucacgcggugaacagaucagcuacuaaaggaguaacccuccugcugcccgaaccugaguggacauauccaaggcucagcugucccgguaguaccuuccaaaaggccuuacugauuuccccucaucgguuuggcgaaacuaaaggaaauucugcaccacuuaucauucgcgagcccuucaucgccugcgggccuaacgaauguaagcacuuugcuuugacacauuacgcagcccagccaggcgguuauuacaaugggacccgaggagaccguaacaaacugagacaccuaauaagcgugaagcucggcaagaucccgacggucgaaaauuccauuuuccauauggcugccuggucaggcagugcgugccacgaugggaaagaguggacuuauaucggaguggacggucccgauaacaaugcacugcuuaagauuaaauacggcgaggccuacaccgacacauaucacagcuacgcuaacaauauccugaggacucaggagucugccuguaacugcauagggggaaauuguuauuugaugauuaccgauggcuccgcaucagguguuagcgaaugccgguuucucaagauccgcgaggggagaauuaucaaagagaucuucccuacaggaagggugaagcauaccgaagaguguacgugcggcuuugcuaguaacaagacuauugaaugugccugccgggacaauucuuacacagcgaaacgcccauucgucaagcugaacguggagaccgauacugccgaaauacgauuaaugugcacagacaccuaucuggauacgcccagaccugacgauggcuccaucaccgggccaugugagagcaacggagacaaagguucgggcgggauuaagggaggcuuuguacaccagaggauggcaucuaaaaucggucggugguacucccguacaaugucaaagacugagcgcauggggaugggccucuauguuaaauacgacggagaucccugggcugacagugaugcccuugcuuucagcggcgugauggucuccaugaaggaaccggggugguacucuuuuggauucgagauaaaggacaaaaagugcgaugugccuuguauugguaucgaaauggugcaugacggcgggaaagagaccuggcacagcgccgcaacagccaucuauugccugaugggaucaggccaauugcuaugggauacugucaccgguguugacauggcucuguga

SEQ ID NO: 151417 - RNA, 1401 nt, Artificial Sequence; identical to SEQ ID NO: 151416
  derived and/or modified sequence opt3 from neuraminidase__InfluenzaB__AGX19308

SEQ ID NO: 151418 - RNA, 1401 nt, Artificial Sequence; identical to SEQ ID NO: 151416
  derived and/or modified sequence opt3 from neuraminidase__InfluenzaB__AGX19319

SEQ ID NO: 151419 - RNA, 1401 nt, Artificial Sequence
  derived and/or modified sequence opt3 from neuraminidase__InfluenzaB__AGX19330
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucacgcggugaacagaucagcuacuaaaggaguaacccuccugcugcccgaaccugaguggacauauccaaggcucagcugucccgguaguaccuuccaaaaggccuuacugauuuccccucaucgguuuggcgaaacuaaaggaaauucugcaccacuuaucauucgcgagcccuucaucgccugcgggccuaacgaauguaagcacuuugcuuugacacauuacgcagcccagccaggcgguuauuacaaugggacccgaggaaaccguaauaaacugagacaccuaauaagcgugaagcucggcaagaucccgacggucgagaacuccauuuuccauauggcugccuggucaggcagugcgugccacgacgggaaagaguggacuuauaucggaguggauggucccgacaauaacgcacugcuuaagauuaaauacggcgaagccuacaccgauacauaucacagcuacgcuaauaacauccugaggacucaggagucugccuguaauugcauagggggaaacuguuauuugaugauuaccgacggcuccgcaucagguguuagcgaaugccgguuucucaagauccgcgaggggagaauuaucaaagagaucuucccuacaggaagggugaagcauaccgaagaguguacgugcggcuuugcuaguaauaagacuauugaaugugccugccgggauaacucuuacacagcgaaacgcccauucgucaagcugaacguggagaccgacacugccgaaauacgauuaaugugcacagauaccuaucuggacacgcccagaccugaugacggcuccaucaccgggccaugugagagcaauggagauaaagguucgggcgggauuaagggaggcuuuguacaccagaggauggcaucuaaaaucggucggugguacucccguacaaugucaaagacugagcgcauggggaugggccucuauguuaaauacgacggagaccccugggcugauagugacgcccuugcuuucagcggcgugauggucuccaugaaggaaccggggugguacucuuuuggauucgagauaaaggauaaaaagugcgacgugccuuguauugguaucgaaauggugcaugauggcgggaaagagaccuggcacagcgccgcaacagccaucuauugccugaugggaucaggccaauugcuaugggacacugucaccgguguugauauggcucuguga

SEQ ID NO: 151420 - RNA, 1401 nt, Artificial Sequence; identical to SEQ ID NO: 151416
  derived and/or modified sequence opt3 from neuraminidase__InfluenzaB__AGX19341

SEQ ID NO: 151421 - RNA, 1401 nt, Artificial Sequence; identical to SEQ ID NO: 151416
  derived and/or modified sequence opt3 from neuraminidase__InfluenzaB__AGX19352

SEQ ID NO: 151422 - RNA, 1401 nt, Artificial Sequence
  derived and/or modified sequence opt3 from neuraminidase__InfluenzaB__AGX19363
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucacgcggugaacagaucagcuacuaaaggaguaacccuccugcugcccgaaccugaguggacauauccaaggcucagcugucccgguaguaccuuccaaaaggccuuacugauuuccccucaucgguuuggcgaaacuaaaggaaauucugcaccacuuaucauucgcgagcccuucaucgccugcgggccuaacgaauguaagcacuuugcuuugacauacuaugcagcccagccaggcgguuacuauaaugggacccgaggagaccguaacaaacugagacaucuaauaagcgugaagcucggcaagaucccgacggucgaaaauuccauuuuccacauggcugccuggucaggcagugcgugccaugaugggaaagaguggacuuacaucggaguggacggucccgauaacaaugcacugcuuaagauuaaauacggcgaggccuauaccgacacauaccacagcuaugcuaacaauauccugaggacucaggagucugccuguaacugcauagggggaaauuguuacuugaugauuaccgauggcuccgcaucagguguuagcgaaugccgguuucucaagauccgcgaggggagaauuaucaaagagaucuucccuacaggaagggugaagcacaccgaagaguguacgugcggcuuugcuaguaacaagacuauugaaugugccugccgggacaauucuuauacagcgaaacgcccauucgucaagcugaacguggagaccgauacugccgaaauacgauuaaugugcacagacaccuaccuggauacgcccagaccugacgauggcuccaucaccgggccaugugagagcaacggagacaaagguucgggcgggauuaagggaggcuuuguacaucagaggauggcaucuaaaaucggucggugguauucccguacaaugucaaagacugagcgcauggggaugggccucuacguuaaauacgacggagaucccugggcugacagugaugcccuugcuuucagcggcgugauggucuccaugaaggaaccggggugguauucuuuuggauucgagauaaaggacaaaaagugcgaugugccuuguauugguaucgaaauggugcacgacggcgggaaagagaccuggcauagcgccgcaacagccaucuacugccugaugggaucaggccaauugcuaugggauacugucaccgguguugacauggcucuguga

SEQ ID NO: 151423 - RNA, 1401 nt, Artificial Sequence
  derived and/or modified sequence opt3 from neuraminidase__InfluenzaB__AGX19374
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugagcgaaccggaguggaccuaucccaggcucaguuguccugguuccacauuccagaaggcauuacugauuucuccacaccgguuuggcgaaaccaaagggaauagcgcuccccuuaucauucgcgagccuuucaucgccugcggaccaacugaauguaagcauuuugcauugacacacuacgccgcucagcccggcgguuauuacaacgggacccgagaggaccguaauaaacugagacaucuaauauccgugaagcucggaaagaucccuacggucgagaacucaauuuuccacauggccgcguggaguggcagcgcaugccaugauggcaaagaauggacuuauaucgggguggacggaccagauucuaaugcccugcuuaagauuaaauacggugaggcuuacaccgacacauaucacuccuacgccaagaacauccugaggacucaagaaucagcauguaauugcauaggcggggauuguuauuugaugauuaccgacggaccggcuagcggcguuagugagugccgguuucucaaaauccgcgaggguagaauuaucaaggaaaucuuccccacagggagggugaagcacaccgaggaauguacgugcggauuugccucuaacaaaacuauugagugugcgugccgggauaauuccuacacagccaagcgcccuuucgucaaacugaacguggaaaccgacacugcagagauacgauuaaugugcacagagaccuaucuggauacgccaagacccaaugacggcagcaucaccggcccuugugaaucggauggggacaagggaucugguggcauuaaagggggauuuguacaucagaggauggcuuccaagaucggccggugguacucacguacaaugaguaaaacuaagcgcauggguauggggcucuauguuaaguacgacggcgauccauggaccgacagcgaggcccuugcucuguccggagugauggucucuauggaggaacccggcugguacagcuucggguuugaaauaaaagauaagaaaugcgacgugccguguauuggaaucgagauggugcacgaugguggcaagacaacuuggcauucagccgcaaccgccaucuauugcuugauggggaguggacagcuacugugggacacagucaccggcguugauauggcucucuga

SEQ ID NO: 151424 - RNA, 1401 nt, Artificial Sequence; identical to SEQ ID NO: 151416
  derived and/or modified sequence opt3 from neuraminidase__InfluenzaB__AGX19385

SEQ ID NO: 151425 - RNA, 1401 nt, Artificial Sequence
  derived and/or modified sequence opt3 from neuraminidase__InfluenzaB__AGX19396
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaaugccguuggauugcgcaaacgccucgaauguucacgcggugaacagaucagcuacuaaaggaguaacccuccugcugcccgaaccugaguggacauauccaaggcucagcugucccgguaguaccuuccaaaaggccuuacugauuuccccucaucgguuuggcgaaacuaaaggaaauucugcaccacuuaucauucgcgagcccuucaucgccugcgggccuaacgaauguaagcacuuugcuuugacacauuacgcagcccagccaggcgguuauuacaaugggccgcgaggagaccguaacaaacugagacaccuaauaagcgugaagcucggcaagauccccaccgucgaaaauuccauuuuccauauggcugccuggucaggcagugcgugccacgaugggaaagaguggacguauaucggaguggacgguccugauaacaaugcacugcuuaagauuaaauacggcgaggccuacacugacaccuaucacagcuacgcuaacaauauccugaggacacaggagucugccuguaacugcauagggggaaauuguuauuugaugauuacugauggcuccgcaucagguguuagcgaaugccgguuucucaagauccgcgaggggagaauuaucaaagagaucuucccaaccggaagggugaagcauacagaagaguguaccugcggcuuugcuaguaacaagacgauugaaugugccugccgggacaauucuuacacugcgaaacgccccuucgucaagcugaacguggagacagauaccgccgaaauacgauuaaugugcacugacacauaucuggauaccccuagaccagacgauggcuccaucacggggcccugugagagcaacggagacaaagguucgggcgggauuaagggaggcuuuguacaccagaggauggcaucuaaaaucggucggugguacucccguaccaugucaaagacagagcgcauggggaugggccucuauguuaaauacgacggagauccgugggcugacagugaugcccuugcuuucagcggcgugauggucuccaugaaggaaccugggugguacucuuuuggauucgagauaaaggacaaaaagugcgaugugcccuguauugguaucgaaauggugcaugacggcgggaaagagacuuggcacagcgccgcaaccgccaucuauugccugaugggaucaggccaauugcuaugggauacagucacugguguugacauggcucuguga

SEQ ID NO: 151426 - RNA, 1401 nt, Artificial Sequence; identical to SEQ ID NO: 151416
  derived and/or modified sequence opt3 from neuraminidase__InfluenzaB__AGX19407

SEQ ID NO: 151427 - RNA, 1401 nt, Artificial Sequence; identical to SEQ ID NO: 150977
  derived and/or modified sequence opt3 from neuraminidase__InfluenzaB__AGX19418

SEQ ID NO: 151428 - RNA, 1401 nt, Artificial Sequence
  derived and/or modified sequence opt3 from neuraminidase__InfluenzaB__AGX19429
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacucgcagaauggguauggggcucuauguaaaguacgacggcgaucccuggaccgacagugaggcccuugcucugagcggaguuaugguguccauggaggaaccgggcugguacucuuucggguuugaaauuaaggauaaaaagugcgacgucccuuguaucggaaucgagauggugcacgaugguggcaaaacaacuuggcauagcgccgcaaccgccauuuauugcuugauggggucaggacagcuacugugggacacagugaccggcgucgauauggcucucuga

SEQ ID NO: 151429 - RNA, 1401 nt, Artificial Sequence
  derived and/or modified sequence opt3 from neuraminidase__InfluenzaB__AGX19451
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaaccauucagcuaccaaaggaguaacacuccugcugcccgaaccugaguggaccuauccaagacucagcugucccgguaguacuuuccaaaaggccuuacugaucuccccucacagguuuggcgaaacaaaaggaaauucugcaccacuuauuauccgggagcccuucauugccugcgggccuaacgaauguaagcauuuugcuuugacccacuacgcagcccagccaggcgguuauuacaaugggacgcgcggagaccgaaacaaacugcgucaucuaaucagcgugaagcucggcaagauaccgacugucgaaaauuccaucuuccacauggcugccuggucaggcagugcgugccacgaugggaaagaguggaccuauauuggaguggacggucccgauaacaaugcacugcuuaagaucaaauacggcgaggccuacacagacacuuaucauagcuacgcuaacaauauucugagaacccaggagucugccuguaacugcaucgggggaaauuguuauuugaugguuacagauggcuccgcaucaggugugagcgaaugcagguuucucaagauacgggaggggcgcauuaucaaagagauuuucccuaccggaagagucaagcacacggaagaguguacuugcggcuuugcuaguaacaagacaaucgaaugugccugcagggacaauucuuacaccgcgaaacggccauucgugaagcugaacguagagacugauacagccgaaauccgcuuaaugugcaccgacacguaucuggauacaccccgaccugacgauggcuccauuaccgggccaugugagagcaacggagacaaagguucgggcgggauaaagggaggcuuuguucaucagagaauggcaucuaaaaucgguaggugguacucccggacuaugucaaagaccgagcguauggggaugggccucuaugugaaauacgacggagaucccugggcugacagugaugcccuugcuuucagcggcgucaugguguccaugaaggaaccggggugguacucuuuuggauucgagauuaaggacaaaaagugcgaugugccuuguaucgguauagaaaugguccacgacggcgggaaagagacauggcacagcgccgcaacugccauuuauugccugaugggaucaggccaauugcuaugggauaccguuacagguguggacauggcucuguga

SEQ ID NO: 151430 - RNA, 1401 nt, Artificial Sequence; identical to SEQ ID NO: 151428
  derived and/or modified sequence opt3 from neuraminidase__InfluenzaB__AGX19462

SEQ ID NO: 151431 - RNA, 1401 nt, Artificial Sequence; identical to SEQ ID NO: 151428
  derived and/or modified sequence opt3 from neuraminidase__InfluenzaB__AGX19473

SEQ ID NO: 151432 - RNA, 1401 nt, Artificial Sequence; identical to SEQ ID NO: 150977
  derived and/or modified sequence opt3 from neuraminidase__InfluenzaB__AGX19484

SEQ ID NO: 151433 - RNA, 1401 nt, Artificial Sequence; identical to SEQ ID NO: 151429
  derived and/or modified sequence opt3 from neuraminidase__InfluenzaB__AGX19495

SEQ ID NO: 151434 - RNA, 1401 nt, Artificial Sequence; identical to SEQ ID NO: 150977
  derived and/or modified sequence opt3 from neuraminidase__InfluenzaB__AGX19506

SEQ ID NO: 151435 - RNA, 1401 nt, Artificial Sequence; identical to SEQ ID NO: 150977
  derived and/or modified sequence opt3 from neuraminidase__InfluenzaB__AGX19517

SEQ ID NO: 151436 - RNA, 1401 nt, Artificial Sequence; identical to SEQ ID NO: 150977
  derived and/or modified sequence opt3 from neuraminidase__InfluenzaB__AGX19528

SEQ ID NO: 151437 - RNA, 1401 nt, Artificial Sequence; identical to SEQ ID NO: 151429
  derived and/or modified sequence opt3 from neuraminidase__InfluenzaB__AGX19539

SEQ ID NO: 151438 - RNA, 1401 nt, Artificial Sequence
  derived and/or modified sequence opt3 from neuraminidase__InfluenzaB__AGX19550
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaaccauucagcuaccaaaggaguaacacuccugcugcccgaaccugaguggaccuauccaagacucagcugucccgguaguacuuuccaaaaggccuuacugaucuccccucacagguuuggcgaaacaaaaggaaauucugcaccacuuauuauccgggagcccuucauugccugcgggccuaacgaauguaagcauuuugcuuugacccacuacgcagcccagccaggcgguuauuacaaugggacgcgcggagaccgaaacaaacugcgucaucuaaucagcgugaagcucggcaagauaccgacugucgaaaauuccaucuuccacauggcugccuggucaggcagugcgugccacgaugggaaagaguggaccuauauuggaguggacggucccgauaacaaugcacugcuuaagaucaaauacggcgaggccuacacagacacuuaucauagcuacgcuaacaauauucugagaacccaggagucugccuguaacugcaucgggggaaauuguuauuugaugguuacagauggcuccgcaucaggugugagcgaaugcagguuucucaagauacgggaggggcgcauuaucaaagagauuuucccuaccggaagagucaagcacacggaagaguguacuugcggcuuugcuaguaacaagacaaucgaaugugccugcagggacaauucuuacaccgcgaaacggccauucgugaagcugaacguagagacugauacagccgaaauccgcuuaaugugcaccgacacguaucuggauacaccccgaccugacgauggcuccauuaccgggccaugugagagcaacggagacaaagguucgggcgggauaaagggaggcuuuguucaucagagaauggcaucuaaaaucgguaggugguacucccggacuaugucaaagaccgagcguauggggaugggccucuaugugaaauacgacggagaucccugggcugacagugaugcccuugcuuucagcggcgucaugguguccaugaaugaaccggggugguacucuuuuggauucgagauuaaggacaagaaaugcgaugugccuuguaucgguauagaaaugguccacgacggcgggaaggagacauggcacagcgccgcaacugccauuuauugccugaugggaucaggccaauugcuaugggauaccguuacagguguggacauggcucuguga

SEQ ID NO: 151439 - RNA, 1401 nt, Artificial Sequence
  derived and/or modified sequence opt3 from neuraminidase__InfluenzaB__AGX19561
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaaccauucagcuaccaaaggaguaacacuccugcugcccgaaccugaguggaccuauccaagacucagcugucccgguaguacuuuccaaaaggccuuacugaucuccccucacagguuuggcgaaacaaaaggaaauucugcaccacuuauuauccgggagcccuucauugccugcgggccuaacgaauguaagcauuuugcuuugacccacuacgcagcccagccacgcggcuauuacaaugguacgcgaggggaccguaacaaacugagacaucuaaucagcgugaagcucggaaagauaccgacugucgaaaauuccaucuuccacauggcugccuggucaggcagugcgugccacgauggcaaagaguggaccuauauugggguggacggacccgauaacaaugcacugcuuaagaucaaauacggugaggccuacacagacacuuaucauagcuacgcuaacaauauucugaggacccaggagucugccuguaacugcaucggcgggaauuguuauuugaugguuacagauggauccgcaucaggcgugagcgaaugccgguuucucaagauacgcgaggguagaauuaucaaagagauuuucccuaccgggagggucaagcacacggaagaguguacuugcggauuugcuaguaacaagacaaucgaaugugccugccgggacaauucuuacaccgcgaaacgcccauucgugaagcugaacguagagacugauacagccgaaauccgauuaaugugcaccgacacguaucuggauacccccagaccugacgauggcuccauuacaggcccaugugagagcaacggggacaaaggaucggguggcauaaaagggggauuuguucaucagaggauggcaucuaagaucggccggugguacucccguacuaugucaaagaccgagcgcauggguauggggcucuaugugaaauacgacggcgaucccugggcugacagugaugcccuugcuuucagcggagucaugguguccaugaaggaaccgggcugguacucuuuuggguucgagauuaaggacaaaaagugcgaugugccuuguaucggaauagaaaugguccacgacgguggcaaagagacauggcacagcgccgcaacugccauuuauugccugauggggucaggacaauugcuaugggauaccguuacaggcguggacauggcucuguga

SEQ ID NO: 151440 - RNA, 1401 nt, Artificial Sequence
  derived and/or modified sequence opt3 from neuraminidase__InfluenzaB__AGX19572
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccugggcagauagugacgcucuugccuucagcggcgucaugguguccaugaaggagccggggugguacucuuuuggauucgaaauuaaagauaagaaaugcgacgugccuuguaucgguauagagaugguccacgauggcgggaaggaaacauggcauagcgcugccacugcaauuuauugccugaugggaucaggccaguugcuaugggacaccguuacaggugugaauauggcccuguga

SEQ ID NO: 151441 - RNA, 1401 nt, Artificial Sequence; identical to SEQ ID NO: 150977
  derived and/or modified sequence opt3 from neuraminidase__InfluenzaB__AGX19583

SEQ ID NO: 151442 - RNA, 1401 nt, Artificial Sequence; identical to SEQ ID NO: 150977
  derived and/or modified sequence opt3 from neuraminidase__InfluenzaB__AGX19594

SEQ ID NO: 151443 - RNA, 1401 nt, Artificial Sequence; identical to SEQ ID NO: 150977
  derived and/or modified sequence opt3 from neuraminidase__InfluenzaB__AGX19605

SEQ ID NO: 151444 - RNA, 1401 nt, Artificial Sequence; identical to SEQ ID NO: 150977
  derived and/or modified sequence opt3 from neuraminidase__InfluenzaB__AGX19616

SEQ ID NO: 151445 - RNA, 1401 nt, Artificial Sequence; identical to SEQ ID NO: 151429
  derived and/or modified sequence opt3 from neuraminidase__InfluenzaB__AGX19627

SEQ ID NO: 151446 - RNA, 1401 nt, Artificial Sequence; identical to SEQ ID NO: 150977
  derived and/or modified sequence opt3 from neuraminidase__InfluenzaB__AGX19638

SEQ ID NO: 151447 - RNA, 1401 nt, Artificial Sequence; identical to SEQ ID NO: 151429
  derived and/or modified sequence opt3 from neuraminidase__InfluenzaB__AGX19649

SEQ ID NO: 151448 - RNA, 1401 nt, Artificial Sequence; identical to SEQ ID NO: 151429
  derived and/or modified sequence opt3 from neuraminidase__InfluenzaB__AGX19660

SEQ ID NO: 151449 - RNA, 1401 nt, Artificial Sequence; identical to SEQ ID NO: 150977
  derived and/or modified sequence opt3 from neuraminidase__InfluenzaB__AGX19671

SEQ ID NO: 151450 - RNA, 1401 nt, Artificial Sequence; identical to SEQ ID NO: 150977
  derived and/or modified sequence opt3 from neuraminidase__InfluenzaB__AGX19682

SEQ ID NO: 151451 - RNA, 1401 nt, Artificial Sequence; identical to SEQ ID NO: 151429
  derived and/or modified sequence opt3 from neuraminidase__InfluenzaB__AGX19704

SEQ ID NO: 151452 - RNA, 1401 nt, Artificial Sequence
  derived and/or modified sequence opt3 from neuraminidase__InfluenzaB__AGX19715
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucaaccacaaaaggaguaacccuccugcugcccgaaccugaguggacuuauccaaggcucagcugucccgguaguacauuccaaaaggcuuuacugaucuccccucaucgguuuggcgaaaccaaaggaaauucugccccacuuauuauccgcgagcccuucauugcaugcgggccuaacgaauguaagcacuuugccuugacgcauuacgcugcacagccaggcgguuauuacaaugggacucgaggagaccguaacaaacugagacaccuaaucagcgugaagcucggcaagauaccgaccgucgaaaauuccaucuuccauauggccgcuuggucaggcagugccugccacgaugggaaagaguggacauauauuggaguggacggucccgauaacaaugcgcugcuuaagaucaaauacggcgaggcauacacugacaccuaucacagcuacgccaacaauauucugaggacacaggagucugcuuguaacugcaucgggggaaauuguuauuugaugauaaccgauggcuccgccucagguguuagcgaaugccgguuucucaagauucgcgaggggagaaucauuaaagagaucuucccuacgggaagggugaagcauacugaagaguguacaugcggcuuugcaaguaacaagaccaucgaaugugcuugccgggacaauucuuacacugccaaacgcccauucgucaagcugaacguggagacagauaccgcggaaauucgauuaaugugcacggacaccuaucuggauacacccagaccugacgauggcuccauaacugggccaugugagagcaacggagacaaagguucgggcgggaucaagggaggcuuuguacaccagaggauggccucuaaaauuggucggugguacucccguaccaugucaaagacagagcgcauggggaugggccucuauguuaaauacgacggagaucccugggcagacagugaugcucuugccuucagcggcgugauggucuccaugaaggaaccggggugguacucuuuuggauucgagaucaaggacaaaaagugcgaugugccuuguauagguauugaaauggugcaugacggcgggaaagagacuuggcacagcgcugccaccgcaaucuauugccugaugggaucaggccaauugcuaugggauacagucaccgguguugacauggcccuguga

SEQ ID NO: 151453 - RNA, 1401 nt, Artificial Sequence; identical to SEQ ID NO: 150977
  derived and/or modified sequence opt3 from neuraminidase__InfluenzaB__AGX19726

SEQ ID NO: 151454 - RNA, 1401 nt, Artificial Sequence; identical to SEQ ID NO: 150977
  derived and/or modified sequence opt3 from neuraminidase__InfluenzaB__AGX19737

SEQ ID NO: 151455 - RNA, 1401 nt, Artificial Sequence; identical to SEQ ID NO: 150977
  derived and/or modified sequence opt3 from neuraminidase__InfluenzaB__AGX19748

SEQ ID NO: 151456 - RNA, 1401 nt, Artificial Sequence; identical to SEQ ID NO: 151429
  derived and/or modified sequence opt3 from neuraminidase__InfluenzaB__AGX19759

SEQ ID NO: 151457 - RNA, 1401 nt, Artificial Sequence; identical to SEQ ID NO: 150977
  derived and/or modified sequence opt3 from neuraminidase__InfluenzaB__AGX19770

SEQ ID NO: 151458 - RNA, 1401 nt, Artificial Sequence; identical to SEQ ID NO: 150977
  derived and/or modified sequence opt3 from neuraminidase__InfluenzaB__AGX19781

SEQ ID NO: 151459 - RNA, 1401 nt, Artificial Sequence; identical to SEQ ID NO: 150977
  derived and/or modified sequence opt3 from neuraminidase__InfluenzaB__AGX19792

SEQ ID NO: 151460 - RNA, 1401 nt, Artificial Sequence; identical to SEQ ID NO: 150977
  derived and/or modified sequence opt3 from neuraminidase__InfluenzaB__AGX19803

SEQ ID NO: 151461 - RNA, 1401 nt, Artificial Sequence; identical to SEQ ID NO: 150977
  derived and/or modified sequence opt3 from neuraminidase__InfluenzaB__AGX19814

SEQ ID NO: 151462 - RNA, 1401 nt, Artificial Sequence
  derived and/or modified sequence opt3 from neuraminidase__InfluenzaB__AGX19825
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaaccauucagcuaccaaaggaguaacacuccugcugcccgaaccugaguggaccuauccaagacucagcugucccgguaguacuuuccaaaaggccuuacugaucuccccucacagguuuggcgaaacaaaaggaaauucugcaccacuuauuauccgggagcccuucauugccugcgggccuaacgaauguaagcauuuugcuuugacccacuacgcagcccagccaggcgguuauuacaaugggacgcgcggagaccgaaacaaacugcgucaucuaaucagcgugaagcucggcaagauaccgacugucgaaaauuccaucuuccacauggcugccuggucaggcagugcgugccacgaugggaaagaguggaccuauauuggaguggacggucccgauaacaaugcacugcuuaagaucaaauacggcgaggccuacacagacacuuaucauagcuacgcuaacaauauucugagaacccaggagucugccuguaacugcaucgggggaaauuguuauuugaugguuacagauggcuccgcaucaggugugagcgaaugcagguuucucaagauacgggaggggcgcauuaucaaagagauuuucccuaccggaagagucaagcacacggaagaguguacuugcggcuuugcuaacaauaagacaaucgaaugugccugcagggacaacaguuacaccgcgaaacggccauucgugaagcugaacguagagacugauacagccgaaauccgcuuaaugugcaccgacacguaucuggauacaccccgaccugacgauggcucuauuaccgggccaugugaguccaauggagacaaagguagcggcgggauaaagggaggcuuuguucaucagagaauggcaucgaaaaucgguaggugguacucucggacuauguccaagaccgagcguauggggaugggccucuaugugaaauacgacggagaucccugggcugacucagaugcccuugcuuucaguggcgucauggugagcaugaaggaaccggggugguacuccuuuggauucgagauuaaggacaaaaagugcgaugugccuuguaucgguauagaaaugguccacgacggcgggaaagagacauggcacucugccgcaacugccauuuauugccugaugggaagcggccaauugcuaugggauaccguuacagguguggacauggcucuguga

SEQ ID NO: 151463 - RNA, 1401 nt, Artificial Sequence; identical to SEQ ID NO: 150977
  derived and/or modified sequence opt3 from neuraminidase__InfluenzaB__AGX19836

SEQ ID NO: 151464 - RNA, 1401 nt, Artificial Sequence; identical to SEQ ID NO: 150977
  derived and/or modified sequence opt3 from neuraminidase__InfluenzaB__AGX19847

SEQ ID NO: 151465 - RNA, 1401 nt, Artificial Sequence; identical to SEQ ID NO: 150977
  derived and/or modified sequence opt3 from neuraminidase__InfluenzaB__AGX19858

SEQ ID NO: 151466 - RNA, 1401 nt, Artificial Sequence; identical to SEQ ID NO: 150977
  derived and/or modified sequence opt3 from neuraminidase__InfluenzaB__AGX19869

SEQ ID NO: 151467 - RNA, 1401 nt, Artificial Sequence; identical to SEQ ID NO: 150977
  derived and/or modified sequence opt3 from neuraminidase__InfluenzaB__AGX19880

SEQ ID NO: 151468 - RNA, 1401 nt, Artificial Sequence; identical to SEQ ID NO: 150977
  derived and/or modified sequence opt3 from neuraminidase__InfluenzaB__AGX19891

SEQ ID NO: 151469 - RNA, 1401 nt, Artificial Sequence; identical to SEQ ID NO: 150977
  derived and/or modified sequence opt3 from neuraminidase__InfluenzaB__AGX19902

SEQ ID NO: 151470 - RNA, 1401 nt, Artificial Sequence
  derived and/or modified sequence opt3 from neuraminidase__InfluenzaB__AGX19913
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcgaugaaccauucagcuaccaaaggagugacacuccugcugcccgaaccugaguggaccuauccaagacucagcugucccgguaguacuuuccaaaaggccuuacugaucuccccucacagguuuggcgaaacaaaaggaaauucugcaccacuuauuauccgggagcccuucauugccugcgggccuaacgaauguaagcauuuugcuuugacccacuacgcagcccagccaggcgguuauuacaaugggacgcgcggagaccgaaacaaacugcgucaucuaaucagcguaaagcucggcaagauaccgacuguggaaaauuccaucuuccacauggcugccuggucaggcagugcgugccacgaugggaaagaguggaccuauauuggagucgacggucccgauaacaaugcacugcuuaagaucaaauacggcgaggccuacacagacacuuaucauagcuacgcuaacaauauucugagaacccaggagucugccuguaacugcaucgggggaaauuguuauuugauggugacagauggcuccgcaucagguguuagcgaaugcagguuucucaagauacgggaggggcgcauuaucaaagagauuuucccuaccggaagagugaagcacacggaagaguguacuugcggcuuugcuaguaacaagacaaucgaaugugccugcagggacaauucuuacaccgcgaaacggccauucgucaagcugaacguggagacugauacagccgaaauccgcuuaaugugcaccgacacguaucuggauacaccccgaccugacgauggcuccauuaccgggccaugugagagcaacggagacaaagguucgggcgggauaaagggaggcuuuguacaucagagaauggcaucuaaaaucgguaggugguacucccggacuaugucaaagaccgagcguauggggaugggccucuauguuaaauacgacggagaucccugggcugacagugaugcccuugcuuucagcggcgugauggucuccaugaaggaaccggggugguacucuuuuggauucgagauuaaggacaaaaagugcgaugugccuuguaucgguauagaaauggugcacgacggcgggaaagagacauggcacagcgccgcaacugccauuuauugccugaugggaucaggccaauugcuaugggauaccgucacagguguugacauggcucuguga

SEQ ID NO: 151471 - RNA, 1401 nt, Artificial Sequence; identical to SEQ ID NO: 150977
  derived and/or modified sequence opt3 from neuraminidase__InfluenzaB__AGX19924

SEQ ID NO: 151472 - RNA, 1401 nt, Artificial Sequence; identical to SEQ ID NO: 150977
  derived and/or modified sequence opt3 from neuraminidase__InfluenzaB__AGX19935

SEQ ID NO: 151473 - RNA, 1401 nt, Artificial Sequence; identical to SEQ ID NO: 150977
  derived and/or modified sequence opt3 from neuraminidase__InfluenzaB__AGX19946

SEQ ID NO: 151474 - RNA, 1401 nt, Artificial Sequence; identical to SEQ ID NO: 150977
  derived and/or modified sequence opt3 from neuraminidase__InfluenzaB__AGX19957

SEQ ID NO: 151475 - RNA, 1401 nt, Artificial Sequence
  derived and/or modified sequence opt3 from neuraminidase__InfluenzaB__AGX19968
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuucucaaaauacgcgaggggagaauuaucaaggagauuuucccuaccggaagggucaagcacacggaagaguguacuugcggcuuugcuaguaacaaaacaaucgaaugugccugccgggauaauucuuacaccgcgaagcgcccauucgugaaacugaacguagagacugacacagccgaaauccgauuaaugugcaccgauacguaucuggacacccccagaccuaaugauggcuccauuacagggccaugugagagcaacggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccugggcagacagugaugcucuugccuucagcggcgucaugguguccaugaaggagccggggugguacucuuuuggauucgaaauuaaagacaagaaaugcgaugugccuuguaucgguauagagaugguccacgacggcgggaaggaaacauggcauagcgcugccacugcaauuuauugccugaugggaucaggccaguugcuaugggauaccguuacaggugugaacauggcccuguga

SEQ ID NO: 151476 - RNA, 1401 nt, Artificial Sequence; identical to SEQ ID NO: 151429
  derived and/or modified sequence opt3 from neuraminidase__InfluenzaB__AGX19979

SEQ ID NO: 151477 - RNA, 1401 nt, Artificial Sequence; identical to SEQ ID NO: 151429
  derived and/or modified sequence opt3 from neuraminidase__InfluenzaB__AGX19990

SEQ ID NO: 151478 - RNA, 1401 nt, Artificial Sequence; identical to SEQ ID NO: 150977
  derived and/or modified sequence opt3 from neuraminidase__InfluenzaB__AGX20001

SEQ ID NO: 151479 - RNA, 1401 nt, Artificial Sequence; identical to SEQ ID NO: 150977
  derived and/or modified sequence opt3 from neuraminidase__InfluenzaB__AGX20012

SEQ ID NO: 151480 - RNA, 1401 nt, Artificial Sequence; identical to SEQ ID NO: 150977
  derived and/or modified sequence opt3 from neuraminidase__InfluenzaB__AGX20023

SEQ ID NO: 151481 - RNA, 1401 nt, Artificial Sequence; identical to SEQ ID NO: 150977
  derived and/or modified sequence opt3 from neuraminidase__InfluenzaB__AGX20034

SEQ ID NO: 151482 - RNA, 1401 nt, Artificial Sequence; identical to SEQ ID NO: 150977
  derived and/or modified sequence opt3 from neuraminidase__InfluenzaB__AGX20045

SEQ ID NO: 151483 - RNA, 1401 nt, Artificial Sequence
  derived and/or modified sequence opt3 from neuraminidase__InfluenzaB__AGX20056
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuaugauucgcgagcccuucaucgccugcgggccuaacgaauguaagcauuuugcuuugacccacuacgcagcccagccaggcgguuauuacaaugggacgcgaggagaccguaacaaacugagacaucuaauuagcgugaagcucggcaagaucccgacugucgaaaauuccauauuccacauggcugccuggucaggcagugcgugccaugaugggaaagaguggaccuauaucggaguggacggucccgauaacaaugcacugcuuaagguuaaauacggcgaggccuacacagacacuuaucacagcuacgcuaacaagauucugaggacccaggagucugccuguaauugcaucgggggaaacuguuauuugauggugacagauggcuccgcaucaggugucagcgaaugccgguuucucaaaauucgcgaggggagaaucauaaaggagauuuucccuaccggaagggugaagcacacggaagaguguacuugcggcuuugcuaguaauaaaacaaucgaaugugccugccgggacaacucuuacaccgcgaagcgcccauucguaaaacugaauguugagacugauacagccgaaauucgauuaaugugcaccgacacguaucuggauacccccagaccuaacgacggcuccaucacagggccaugugagagcaacggagauaaggguucgggcgggaucaaaggaggcuuugugcaucaaaggauggagucuaagauuggucggugguacucccguacuaugucaaaaaccgaacgcauggggaugggccucuaugucaaguacgacggagaccccugggcagauagugacgcucuugccuucagcggcgugaugguguccaugaaggagccggggugguacucuuuuggauucgaaauaaaagauaagaaaugcgacgucccuuguaucgguauugagaugguucacgauggcgggaaggaaacauggcauagcgcugccacugcaaucuauugccugaugggaucaggccaguugcuaugggacaccgugacagguguagauauggcccuguga

SEQ ID NO: 151484 - RNA, 1401 nt, Artificial Sequence
  derived and/or modified sequence opt3 from neuraminidase__InfluenzaB__AGX20067
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugauggugacagauggcuccgcaucaggugucagcgaaugccgguuucucaaaauccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaaauccgauuaaugugcaccgacacguaucuggauacccccagaccuaacgacggcuccaucacagggccaugugagagcaacggagauaaggguucgggcgggauuaaaggaggcuuugugcaucaaaggauggagucuaagauaggucggugguacucccguacuaugucaaaaaccgaacgcauggggaugggccucuaugucaaguacgacggagaccccugggcagauagugacgcucuugccuucagcggcgugaugguguccaugaaggagccggggugguacucuuuuggauucgaaaucaaagauaagaaaugcgacgucccuuguauugguaucgagaugguucacgauggcgggaaggaaacauggcauagcgcugccacugcaauauauugccugaugggaucaggccaguugcuaugggacaccgugacagguguagauauggcccuguga

SEQ ID NO: 151485 - RNA, 1401 nt, Artificial Sequence; identical to SEQ ID NO: 150977
  derived and/or modified sequence opt3 from neuraminidase__InfluenzaB__AGX20078

SEQ ID NO: 151486 - RNA, 1401 nt, Artificial Sequence; identical to SEQ ID NO: 150977
  derived and/or modified sequence opt3 from neuraminidase__InfluenzaB__AGX20089

SEQ ID NO: 151487 - RNA, 1401 nt, Artificial Sequence
  derived and/or modified sequence opt3 from neuraminidase__InfluenzaB__AGX20100
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcaguucugaaaaucaaguacggcgaagccuacacagacacuuaucacagcuacgcuaauaacauucuuaggacccaggagucugccuguaauugcaucgggggaaacuguuaucugaugauaacagauggcuccgcaucaggugugagcgaaugccgguuuuugaaaauucgcgaggggagaaucauuaaggagaucuucccuaccggaaggauccaacacacggaagaguguacuugcggcuuugcuaguaauaagacaauugaaugugccugccgggacaacucuuacaccgcgaaacgcccauucgucaagcucaauguggagacugauacagccgaaauacgacugaugugcaccaaaacguauuuagacacccccagaccugaugacggcuccaucacagggccaugugagagcaacggagguaagggcucugggggaauuaaaggcgguuuuguacaucagaggauggcaucgaagaucgggcggugguacucccguacuaugucaaaaaccgagcgcaagggcaugggacuguauguuaaguacgauggcgaccccugggcugacagugaugcccucgcuuucagcggggugauggucuccauggaggaaccgggaugguacucuuuugguuucgaaauaaaagacaagaaaugcgaugugccuuguauuggcaucgagauggugcacgacgggggaaaggaaacauggcauagcgccgcaacugccaucuauugccuuaugggcucaggucagcuguugugggauaccgucacagggguuaacauggcucuauga

SEQ ID NO: 151488 - RNA, 1401 nt, Artificial Sequence
  derived and/or modified sequence opt3 from neuraminidase__InfluenzaB__AGX20111
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccugacgauggcuccauuacagggccaugugagagcaacggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccugggcagacagugaugcucuuacauucagcggcgucaugguguccaugaaggagccggggugguacucuuuuggauucgaaauuaaagacaagaaaugcgaugugccuuguaucgguauagagaugguccacgacggcgggaaggaaacuuggcauagcgccgcuaccgccauuuauugccugaugggaucaggccaguugcuaugggauacaguuaccgguguggacauggcacuguga

SEQ ID NO: 151489 - RNA, 1401 nt, Artificial Sequence
  derived and/or modified sequence opt3 from neuraminidase__InfluenzaB__AGX20122
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaaacaaagggaaauuccgcaccucuuauuauccgagagccauuuauugccugcgggcccaacgaauguaaacauuucgcuuugacccacuacgcagcccagccuggcgguuauuacaaugggacgcguggagacagaaacaagcugaggcaucuaaucagcgugaaacucggcaagauaccaacugucgaaaauuccaucuuucacauggcugccuggucaggcagugcgugccaugaugggaaggaguggaccuauauuggaguggacgguccggauaacgacgcacugcuuaaaguuaaguacggcgaggccuacacagauacuuaucacagcuacgcuaauaaaauccugcggacccaggagucugccuguaacugcauugggggaaauuguuauuugaugaucacagacggcuccgcaucaggugugagcgaaugccgcuuccucaagauaagagaggggaggauuaucaaagagauuuuucccaccggacgggucaagcacacggaagaguguacuugcggcuucgcuaguaacaagacaaucgaaugugccugccgcgauaauucuuacaccgcgaaacgaccuuuugugaagcugaacguagagacugacacagccgaaaucagauuaaugugcaccgauacguaucuggacaccccaaggcccgaugacggcuccauuacagggccuugugagagcaauggagacaaagguucgggcgggauaaagggaggcuucguucaucaacggauggagucuaaaaucggucguugguacucccgcacuaugucaaagaccgaaagaauggggaugggccucuaugugaaauacgauggagacccaugggcagauagugacgcucuugccuuuagcggcgucaugguguccaugaaggagcccgggugguacucuuucggauucgaaauuaaggauaaaaagugcgacgugccguguaucgguauagagaugguccacgauggcgggaaagaaacauggcauagcgcugccacugcaauuuauugccugaugggaucaggccaguugcuaugggacaccguuacagguguggauauggcccuguga

SEQ ID NO: 151490 - RNA, 1401 nt, Artificial Sequence
  derived and/or modified sequence opt3 from neuraminidase__InfluenzaB__AGX20133
augcugcccagcaccauccagacacucacucuuuuccugacguccggcgggguguuguuaucucuguacgucucagcccuacucaguuaucugcuuuacagcgacguucuguugaaguuuuccccuaccgagauuacagcuccaacuaugucucucgauugcgcaaacgccucgaaugugcaagcgguaaacagaucagcuaccaaaggagugacauuccugcugccggaacccgaguggaccuauccuaggcucagcuguccagguaguacuuuucagaaggccuuacugauaucuccccaccgguucggcgaaacaaaaggaaauuccgcaccucuuaucauucgcgagccauuuaucgccugcgggcccaacgaauguaagcauuucgcuuugacccacuacgcagcccagccuggcgguuauuacaaugggacgcgaggagaccguaacaaacugagacaucuaauuagcgucaagcucggcaagaucccaacuguggaaaauuccauauuucacauggcugccuggucaggcagugcgugccaugaugggaaagaguggaccuauaucggaguugacgguccggauaacgacgcacugcuuaaggugaaauacggcgaggccuacacagauacuuaucacagcuacgcuaauaagauucugaggacccaggagucugccuguaacugcaucgggggaaauuguuauuugaugauuacagacggcuccgcaucaggugucagcgaaugccgguuccucaaaauccgcgaggggagaauaauuaaggagaucuuucccaccggaagggugaagcacacggaagaguguacuugcggcuucgcuaguaacaaaacaauugaaugugccugccgggauaauucuuacaccgcgaagcgcccuuuuguaaaacugaacguugagacugacacagccgaaauccgauuaaugugcaccgauacguaucuggacaccccaagacccgaugacggcuccaucacagggccuugugagagcaauggagacaaggguucgggcgggauuaaaggaggcuucgugcaucaaaggauggagucuaagauaggucggugguacucccguacuaugucaaaaaccgaacgcauggggaugggccucuaugucaaguacgauggagacccaugggcagauagugacgcucuugccuuuagcggcgugaugguguccaugaaggagcccgggugguacucuuucggauucgaaaucaaagauaagaaaugcgacgucccguguauugguaucgagaugguucacgauggcgggaaggaaacauggcauagcgcugccacugcaauauauugccugaugggaucaggccaguugcuaugggacaccgugacagguguagauauggcccuguga

SEQ ID NO: 151491 - RNA, 1401 nt, Artificial Sequence
  derived and/or modified sequence opt3 from neuraminidase__InfluenzaB__AGX20144
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucagguauaagcgaaugccgguuccucaaaauucgcgaggggagaaucauuaaggagaucuuucccaccggaagggugaagcacacggaagaguguacuugcggcuucgcuaguaacaaaacaaucgaaugugccugccgggauaauucuuacaccgcgaagcgcccuuuugucaaacugaacguggagacugacacagccgaaauucgauuaaugugcaccgauacguaucuggacaccccaagacccgaugacggcuccauaacagggccuugugagagcaauggagacaaggguucgggcgggaucaaaggaggcuucguacaucaaaggauggagucuaagauuggucggugguacucccguacuaugucaaaaaccgaacgcauggggaugggccucuauguuaaguacgauggagacccaugggcagauagugacgcucuugccuuuagcggcgugauggucuccaugaaggagcccgggugguacucuuucggauucgaaaucaaagauaagaaaugcgacgugccguguauagguauugagauggugcacgauggcgggaaggaaacauggcauagcgcugccacugcaaucuauugccugaugggaucaggccaguugcuaugggacaccgucacagguguugauauggcccuguga

SEQ ID NO: 151492 - RNA, 1401 nt, Artificial Sequence; identical to SEQ ID NO: 151491
  derived and/or modified sequence opt3 from neuraminidase__InfluenzaB__AGX20155

SEQ ID NO: 151493 - RNA, 1401 nt, Artificial Sequence; identical to SEQ ID NO: 151491
  derived and/or modified sequence opt3 from neuraminidase__InfluenzaB__AGX20166

SEQ ID NO: 151494 - RNA, 1401 nt, Artificial Sequence; identical to SEQ ID NO: 150911
  derived and/or modified sequence opt3 from neuraminidase__InfluenzaB__AGX20177

SEQ ID NO: 151495 - RNA, 1401 nt, Artificial Sequence; identical to SEQ ID NO: 150911
  derived and/or modified sequence opt3 from neuraminidase__InfluenzaB__AGX20188

SEQ ID NO: 151496 - RNA, 1401 nt, Artificial Sequence; identical to SEQ ID NO: 150888
  derived and/or modified sequence opt3 from neuraminidase__InfluenzaB__AGX20199

SEQ ID NO: 151497 - RNA, 1401 nt, Artificial Sequence; identical to SEQ ID NO: 150911
  derived and/or modified sequence opt3 from neuraminidase__InfluenzaB__AGX20210

SEQ ID NO: 151498 - RNA, 1401 nt, Artificial Sequence; identical to SEQ ID NO: 151491
  derived and/or modified sequence opt3 from neuraminidase__InfluenzaB__AGX20221

SEQ ID NO: 151499 - RNA, 1401 nt, Artificial Sequence
  derived and/or modified sequence opt3 from neuraminidase__InfluenzaB__AGX20232
augcugcccagcaccauccagacacucacucuuuuccugacguccggcgggguguuguuaucucuguacgucucagccagucuaagcuaucuccuguacuccgguauucuucugaaguuuucuccuaccgagauaacagcuccaacuaugccguuggacugcgcaaacgccucgaauguucaagcggugaacagaucagcuaccaaaggaguaacauuccuccugcccgaaccugaguggaccuauccaaggcugagcugucccggcaguacuuuucagaaggcccucuuaaucuccccucaccgguucggggaaacaaaaggaaauucugcaccacugauuauccgcgagcccuuuauugccugcggcccuaacgaauguaagcauuucgcucuuacccacuacgcagcccagccagguggguauuacaauggaacgcgaggcgaucguaacaaauugagacaucugaucagcgugaagcuaggcaagauaccgacugucgaaaauuccaucuuucacauggcugccuggucagggagugcgugccaugacggaaaagaguggaccuauauugguguggauggccccgacaacaaugcacuccugaagguuaaauacggggaggccuacacagauacuuaucacagcuacgcuaacaagauccuuaggacccaggagucugccuguaauugcauuggaggcaacuguuaucugaugaucacagacgguuccgcaucaggggugagcgaaugccgguucuugaaaauacgcgagggaagaauuaucaaggagauuuuuccuaccggcagggucaagcacacggaagaguguacuugcggcuucgcuaguaaugaaacaaucgagugugccugccgggauaacucuuacaccgcgaaacgcccauuugugaagcucaauguagaaacugacacagccgagauccgacugaugugcaccgauacguauuuagacacccccagaccuaacgauggguccauuacaggaccaugugagagcaacggugacaaaggcgggggaggcauaaaggguggguucguucaucaaaggauggaaucgaaaaucggccggugguacucucguacuauguccaagaccgagcgcaugggaaugggccuguaugugaaauacgauggggaccccugggcagacucagaugcucucgccuuuaguggagucauggugagcaugaaggaaccggguugguacuccuucggcuucgagauuaaggacaaaaagugcgaugugccuuguaucgggauagaaaugguccacgacggaggcaaagagacauggcauucugcugccacugcaauuuauugccuuauggguagcgggcagcuguugugggauaccguuacaggcguggacauggcccuauga

SEQ ID NO: 151500 - RNA, 1401 nt, Artificial Sequence; identical to SEQ ID NO: 150911
  derived and/or modified sequence opt3 from neuraminidase__InfluenzaB__AGX20243

SEQ ID NO: 151501 - RNA, 1401 nt, Artificial Sequence; identical to SEQ ID NO: 151491
  derived and/or modified sequence opt3 from neuraminidase__InfluenzaB__AGX20254

SEQ ID NO: 151502 - RNA, 1401 nt, Artificial Sequence; identical to SEQ ID NO: 150888
  derived and/or modified sequence opt3 from neuraminidase__InfluenzaB__AGX20265

SEQ ID NO: 151503 - RNA, 1401 nt, Artificial Sequence; identical to SEQ ID NO: 151491
  derived and/or modified sequence opt3 from neuraminidase__InfluenzaB__AGX20276

SEQ ID NO: 151504 - RNA, 1401 nt, Artificial Sequence; identical to SEQ ID NO: 150911
  derived and/or modified sequence opt3 from neuraminidase__InfluenzaB__AGX20287

SEQ ID NO: 151505 - RNA, 1401 nt, Artificial Sequence
  derived and/or modified sequence opt3 from neuraminidase__InfluenzaB__AGX20298
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguauagagaugguccacgauggcgggaaggaaacauggcagagcgcugccacugcaauuuauugccugaugggaucaggccaguugcuaugggacaccguuacagguguggauauggcccuguga

SEQ ID NO: 151506 - RNA, 1401 nt, Artificial Sequence; identical to SEQ ID NO: 150888
  derived and/or modified sequence opt3 from neuraminidase__InfluenzaB__AGX20320

SEQ ID NO: 151507 - RNA, 1401 nt, Artificial Sequence; identical to SEQ ID NO: 150911
  derived and/or modified sequence opt3 from neuraminidase__InfluenzaB__AGX20331

SEQ ID NO: 151508 - RNA, 1401 nt, Artificial Sequence
  derived and/or modified sequence opt3 from neuraminidase__InfluenzaB__AGX20342
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugauggugacagauggcuccgcaucaggugucagcgaaugccgguuucucaaaauccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaaauccgauuaaugugcaccgacacguaucuggauacccccagaccugacgauggcuccaucacagggccaugugagagcaacggagacaaggguucgggcgggauuaaaggaggcuuugugcaucaaaggauggagucuaagauaggucggugguacucccguacuaugucaaaaaccgaacgcauggggaugggccucuaugucaaguacgacggagaucccugggcagacagugaugcucuugccuucagcggcgugaugguguccaugaaggagccggggugguacucuuuuggauucgaaaucaaagacaagaaaugcgaugucccuuguauugguaucgagaugguucacgacggcgggaaggaaacauggcauagcgcugccacugcaauauauugccugaugggaucaggccaguugcuaugggauaccgugacagguguagacauggcccuguga

SEQ ID NO: 151509 - RNA, 1401 nt, Artificial Sequence
  derived and/or modified sequence opt3 from neuraminidase__InfluenzaB__AGX20353
augcugcccagcaccauccagacacucacucuuuuccugacguccggcgggguguuguuaucucuguacgucucagcccuacucaguuaucugcuuuacagcgacauucuguugaaguuuuccccuaccgagauaaucgcuccaacaaugucucucgauugcgcaaacgccucgaauguucaagcggugaacagaucagcuacuaaaggaguaaccuuccugcugccggaacccgaguggacauauccuaggcucagcuguccagguaguaccuuucagaaggccuuacugauuucuccccaccgguucggcgaaacuaaaggaaauuccgcaccucuuaucauucgcgagccauuuaucgccugcgggcccaacgaauguaagcauuucgcuuugacacacuacgcagcccagccuggcgguuauuacaaucgaacccguggggacagaaacaaacugaggcaucuaauaagcgugaagcucggaaagaucccaacggucgaaaauuccauuuuucacauggcugccuggucaggcagugcgugccaugauggcaaagaguggacuuauaucgggguggacggaccggauaacgacgcacugcuuaagguuaaauacggugaggccuacaccgauacauaucacagcuacgcuaauaagauucugcggacucaggagucugccuguaacugcaucggcgggaauuguuauuugaugauaaccgacggauccgcaucaggcauuagcgaaugccgcuuccucaaaaucagagaggguaggauuaucaaggagaucuuucccacagggcgggugaagcacaccgaagaguguacgugcggauucgcuaguaacaaaacuauugaaugugccugccgcgauaauucuuacacagcgaagcgaccuuuugucaaacugaacguggagaccgacacugccgaaauaagauuaaugugcacagauaccuaucuggacacgccaaggcccgaugacggcuccaucaccggcccuugugagagcaauggggacaagggaucggguggcauuaaagggggauucguacaucaacggauggagucuaagaucggccguugguacucccgcacaaugucaaaaacugaaagaauggguauggggcucuauguuaaguacgauggcgacccaugggcagauagugacgcucuugccuuuagcggagugauggucuccaugaaggagcccggcugguacucuuucggguucgaaauaaaagauaagaaaugcgacgugccguguauuggaaucgagauggugcacgaugguggcaaggaaaccuggcauagcgcugccacagcaaucuauugccugauggggucaggacaguugcuaugggacacugucaccggcguugauauggcccuguga

SEQ ID NO: 151510 - RNA, 1401 nt, Artificial Sequence; identical to SEQ ID NO: 150911
  derived and/or modified sequence opt3 from neuraminidase__InfluenzaB__AGX20364

SEQ ID NO: 151511 - RNA, 1401 nt, Artificial Sequence; identical to SEQ ID NO: 150906
  derived and/or modified sequence opt3 from neuraminidase__InfluenzaB__AGX20375

SEQ ID NO: 151512 - RNA, 1401 nt, Artificial Sequence
  derived and/or modified sequence opt3 from neuraminidase__InfluenzaB__AGX20386
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggacccacccuaggcucagcuguccagguaguacuuuucagaaggccuuacugaucucuccccaucgguucggcgaaacaaaaggaaauuccgcaccucuuauuauccgcgagccauuuauugccugcgggcccaacgaauguaagcacuucgcuuugacccauuaugcagcccagccuggcgguuacuauaaugggacgcgaggagaccguaacaaacugagacaccuaaucagcgugaagcucggcaagauaccaacugucgaaaauuccaucuuucauauggcugccuggucaggcagugcgugccacgaugggaaagaguggaccuacauuggaguggacgguccggauaacgacgcacugcuuaagguuaaauauggcgaggccuacacagauacuuaccacagcuaugcuaauaagauccugaggacccaggagucugccuguaacugcauugggggaaauuguuacuugaugaucacagacggcuccgcaucagguauaagcgaaugccgguuccucaaaauucgcgaggggagaaucauuaaggagaucuuucccaccggaagggugaagcauacggaagaguguacuugcggcuucgcuaguaacaaaacaaucgaaugugccugccgggauaauucuuauaccgcgaagcgcccuuuugucaaacugaacguggagacugacacagccgaaauucgauuaaugugcaccgauacguaccuggacaccccaagacccgaugacggcuccauaacagggccuugugagagcaauggagacaaggguucgggcgggaucaaaggaggcuucguacaccaaaggauggagucuaagauuggucggugguauucccguacuaugucaaaaaccgaacgcauggggaugggccucuacguuaaguaugauggagacccaugggcagauagugacgcucuugccuuuagcggcgugauggucuccaugaaggagcccgggugguacucuuucggauucgaaaucaaagauaagaaaugcgacgugccguguauagguauugagauggugcaugauggcgggaaggaaacauggcacagcgcugccacugcaaucuacugccugaugggaucaggccaguugcuaugggacaccgucacagguguugauauggcccuguga

SEQ ID NO: 151513 - RNA, 1401 nt, Artificial Sequence; identical to SEQ ID NO: 150911
  derived and/or modified sequence opt3 from neuraminidase__InfluenzaB__AGX20397

SEQ ID NO: 151514 - RNA, 1401 nt, Artificial Sequence; identical to SEQ ID NO: 150906
  derived and/or modified sequence opt3 from neuraminidase__InfluenzaB__AGX20408

SEQ ID NO: 151515 - RNA, 1401 nt, Artificial Sequence; identical to SEQ ID NO: 150888
  derived and/or modified sequence opt3 from neuraminidase__InfluenzaB__AGX20419

SEQ ID NO: 151516 - RNA, 1401 nt, Artificial Sequence
  derived and/or modified sequence opt3 from neuraminidase__InfluenzaB__AGX20430
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaagcaaagggaaauuccgccccucuuauuauccgagagccauuuauugcuugcgggcccaacgaauguaaacauuucgcauugacacacuacgccgcucagccuggcgguuauuacaaugggacccguggagacagaaacaagcugaggcaucuaaucagcgugaaacucggcaagauaccaacggucgaaaauuccaucuuucacauggccgcguggucaggcagugcaugccaugaugggaaggaguggacuuauauuggaguggacgguccggauaacgacgcccugcuuaaaguuaaguacggcgaggcuuacaccgauacauaucacagcuacgccaauaaaauccugcggacucaggagucugcauguaacugcauugggggaaauuguuauuugaugaucaccgacggcuccgcuucaggugugagcgaaugccgcuuccucaagauaagagaggggaggauuaucaaagagauuuuucccacaggacgggucaagcacaccgaagaguguacgugcggcuucgccaguaacaagacuaucgaaugugcgugccgcgauaauucuuacacagccaaacgaccuuuugugaagcugaacguagagaccgacacugcagaaaucagauuaaugugcacagauaccuaucuggacacgccaaggcccgaugacggcuccauuaccgggccuugugagagcaauggagacaaagguucgggcgggauaaagggaggcuucguucaucaacggauggagucuaaaaucggucguugguacucccgcacaaugucaaagacugaaagaauggggaugggccucuaugugaaauacgauggagacccaugggcugauagugacgcccuugcuuuuagcggcgucaugguguccaugaaggagcccgggugguacucuuucggauucgaaauuaaggauaaaaagugcgacgugccguguaucgguauagagaugguccacgauggcgggaaagaaaccuggcauagcgccgcaacagccauuuauugccugaugggaucaggccaguugcuaugggacacuguuaccgguguggauauggcucuguga

SEQ ID NO: 151517 - RNA, 1401 nt, Artificial Sequence; identical to SEQ ID NO: 150888
  derived and/or modified sequence opt3 from neuraminidase__InfluenzaB__AGX20441

SEQ ID NO: 151518 - RNA, 1401 nt, Artificial Sequence
  derived and/or modified sequence opt3 from neuraminidase__InfluenzaB__AGX20452
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaguaacauuccuccugccggaacccgaguggaccuauccuaggcugaguuguccagguuccacuuuucagaaggcccucuuaaucucuccccaccgguucggcgaaacaaaagggaauagcgcaccucugauuauccgcgagccauuuauugccugcggacccaacgaauguaagcauuucgcucuuacccacuacgcagcccagccuggcgguuauuacaaugggacgcgaggagaccguaacaaauugagacaucugaucuccgugaagcuaggcaagauaccaacugucgaaaauucaaucuuucacauggcugccuggaguggcagcgcgugccaugaugggaaagaguggaccuauauuggaguggacgguccggauaacgacgcacuccugaagguuaaauacggcgaggccuacacagauacuuaucacucuuacgcuaauaagauccuuaggacccaggaguccgccuguaacugcauugggggaaauuguuaucugaugaucacagacggcucagcaagcggugugagugaaugccgguucuugaaaauacgcgaggggagaauuaucaaggagauuuuucccaccggaagggucaagcacacggaagaguguacuugcggcuucgcuucuaacaaaacaaucgaaugugccugccgggauaauuccuacaccgcgaagcgcccuuuugugaaacucaacguagagacugacacagccgaaauccgacugaugugcaccgauacguauuuagacaccccaagacccgaugacggcagcauuacagggccuugugagucgaauggagacaaggguucuggcgggauaaaaggaggcuucguucaucaaaggauggaguccaagaucggucggugguacucacguacuaugaguaaaaccgaacgcauggggaugggccuguaugugaaguacgauggagacccaugggcagauagcgacgcucucgccuuuuccggcgucauggugucuaugaaggagcccgggugguacagcuucggauucgaaauuagagauaaaaagugcgacgugccguguaucgguauagagaugguccacgauggcgggaaagaaacauggcauucagcugccacugcaauuuauugccuuaugggaaguggccagcuguugugggacaccguuacagguguggauauggcccuauga

SEQ ID NO: 151519 - RNA, 1401 nt, Artificial Sequence; identical to SEQ ID NO: 150911
  derived and/or modified sequence opt3 from neuraminidase__InfluenzaB__AGX20463

SEQ ID NO: 151520 - RNA, 1401 nt, Artificial Sequence; identical to SEQ ID NO: 150911
  derived and/or modified sequence opt3 from neuraminidase__InfluenzaB__AGX20474

SEQ ID NO: 151521 - RNA, 1401 nt, Artificial Sequence; identical to SEQ ID NO: 150911
  derived and/or modified sequence opt3 from neuraminidase__InfluenzaB__AGX20485

SEQ ID NO: 151522 - RNA, 1401 nt, Artificial Sequence; identical to SEQ ID NO: 151491
  derived and/or modified sequence opt3 from neuraminidase__InfluenzaB__AGX20496

SEQ ID NO: 151523 - RNA, 1401 nt, Artificial Sequence; identical to SEQ ID NO: 150911
  derived and/or modified sequence opt3 from neuraminidase__InfluenzaB__AGX20507

SEQ ID NO: 151524 - RNA, 1401 nt, Artificial Sequence; identical to SEQ ID NO: 150911
  derived and/or modified sequence opt3 from neuraminidase__InfluenzaB__AGX20518

SEQ ID NO: 151525 - RNA, 1401 nt, Artificial Sequence
  derived and/or modified sequence opt3 from neuraminidase__InfluenzaB__AGX20529
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaauguaccugccgggauaauucuuacacugccaagcgcccuuuugugaaacugaacguagagacagacaccgcggaaauccgauuaaugugcacggauaccuaucuggacacaccaagacccgaugacggcuccauuacugggccuugugagagcaauggagacaaggguucgggcgggauaaaaggaggcuucguucaucaaaggauggagucuaagaucggucggugguacucccguaccaugucaaaaacagaacgcauggggaugggccucuaugugaaguacgauggagacccaugggccgauagugacgcacuugcuuuuagcggcgucaugguguccaugaaggagcccgggugguacucuuucggauucgaaauuaaagauaagaaaugcgacgugccguguaucgguauagagaugguccacgauggcgggaaggaaacuuggcauagcgccgcuaccgccauuuauugccugaugggaucaggccaguugcuaugggacacaguuaccgguguggauauggcacuguga

SEQ ID NO: 151526 - RNA, 1401 nt, Artificial Sequence; identical to SEQ ID NO: 151489
  derived and/or modified sequence opt3 from neuraminidase__InfluenzaB__AGX20540

SEQ ID NO: 151527 - RNA, 1401 nt, Artificial Sequence; identical to SEQ ID NO: 151135
  derived and/or modified sequence opt3 from neuraminidase__InfluenzaB__AGX20551

SEQ ID NO: 151528 - RNA, 1401 nt, Artificial Sequence; identical to SEQ ID NO: 150888
  derived and/or modified sequence opt3 from neuraminidase__InfluenzaB__AGX20562

SEQ ID NO: 151529 - RNA, 1401 nt, Artificial Sequence; identical to SEQ ID NO: 150911
  derived and/or modified sequence opt3 from neuraminidase__InfluenzaB__AGX20573

SEQ ID NO: 151530 - RNA, 1401 nt, Artificial Sequence
  derived and/or modified sequence opt3 from neuraminidase__InfluenzaB__AGX20584
augcugcccagcaccauccagacacucacucuuuuccugacguccggcgggguguuguuaucucuguacgucucagccagucuaagcuaucuccuguacuccgacauucuucugaaguuuucuucgaccgagauaacagcuccuacuaugccauuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacaaugcacugcuuaagguuaaauacggcgaggccuacacagacacuuaucacucuuacgcuaacaagauccugaggacccaggaguccgccuguaauugcauugggggaaacuguuauuugaugaucacagauggcucagcaagcggugugagugaaugccgguuucucaaaauacgcgaggggagaauuaucaaggagauuuuccccaccggaagggucaagcacacggaagaguguacuugcggcuuugcuucuaauaaaacaaucgaaugugccugccgggacaacuccuacaccgcgaagcgcccuuucgugaaacugaauguagagacugauacagccgaaauccgauuaaugugcaccgacacguaucuggauaccccaagacccaacgacggcagcauuacagggccuugugagucgaacggagauaaggguucuggcgggauaaaaggaggcuuuguucaucaaaggauggagucccggaucggucguugguacucacgcacuaugaguaagaccgaaagaauggggaugggccucuaugugaaauacgacggagacccauggacagauagcgacgcacuuacuuucuccggcgucauggugucuaugaaggagcccgggugguacagcuuuggauucgaaauuaaggauaaaaagugcgacgugccguguaucgguauagagaugguccacgauggcgggaaagaaaccuggcauucagcugccacagcuauuuauugccugaugggaaguggccaguugcuaugggacaccguuacugguguggauauggcccuguga

SEQ ID NO: 151531 - RNA, 1401 nt, Artificial Sequence; identical to SEQ ID NO: 150911
  derived and/or modified sequence opt3 from neuraminidase__InfluenzaB__AGX20595

SEQ ID NO: 151532 - RNA, 1401 nt, Artificial Sequence; identical to SEQ ID NO: 151489
  derived and/or modified sequence opt3 from neuraminidase__InfluenzaB__AGX20606

SEQ ID NO: 151533 - RNA, 1401 nt, Artificial Sequence; identical to SEQ ID NO: 151489
  derived and/or modified sequence opt3 from neuraminidase__InfluenzaB__AGX20617

SEQ ID NO: 151534 - RNA, 1401 nt, Artificial Sequence; identical to SEQ ID NO: 151516
  derived and/or modified sequence opt3 from neuraminidase__InfluenzaB__AGX20628

SEQ ID NO: 151535 - RNA, 1401 nt, Artificial Sequence; identical to SEQ ID NO: 150916
  derived and/or modified sequence opt3 from neuraminidase__InfluenzaB__AGX20639

SEQ ID NO: 151536 - RNA, 1401 nt, Artificial Sequence
  derived and/or modified sequence opt3 from neuraminidase__InfluenzaB__AGX20650
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucuacauguaacugcauugggggaaauuguuauuugaugaucaccgacggcuccgccucaggugugagcgaaugccgguuccucaaaauacgcgaggggagaauuaucaaggagauuuuucccacgggaagggucaagcacacugaagaguguacaugcggcuucgcaaguaacaaaaccaucgaaugugcuugccgggauaauucuuacacugccaagcgcccuuuugugaaacugaacguagagacagacaccgcggaaauccgauuaaugugcacggauaccuaucuggacacaccaagacccgaugacggcuccauuacugggccuugugagagcaauggagacaaggguucgggcgggauaaaaggaggcuucguucaucaaaggauggagucuaagaucggucggugguacucccguaccaugucaaaaacagaacgcauggggaugggccucuaugugaaguacgauggagacccaugggccgauagugacgcacuugcuuuuagcggcgucaugguguccaugaaggagcccgggugguacucuuucggauucgaaauuaaagauaagaaaugcgacgugccguguaucgguauagagaugguccacgauggcgggaaggaaacuuggcauagcgccgcuaccgccauuuauugccugaugggaucaggccaguugcuaugggacacaguuaccgguguggauauggcacuguga

SEQ ID NO: 151537 - RNA, 1401 nt, Artificial Sequence
  derived and/or modified sequence opt3 from neuraminidase__InfluenzaB__AGX20661
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaaucucggcaagauaccgacugucgagaacuccaucuuccacauggcugccuggucaggcagugcgugccaugaugggaaggaguggaccuauauuggaguggacggucccgauaauaacgcacugcuuaaaguuaaguacggcgaagccuacacagacacuuaucacagcuacgcuaauaacauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaaacacacggaagaguguacuugcggcuuugcuaguaauaagacaaucgaaugugccugccgggacaacucuuacaccgcgaagcgcccauucgugaaacugaacguagagacugauacagccgaaauccgauuaaugugcaccgacacguaucuggauacccccagaccuaaugacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccuggacagauagugacgcacuugcuuucagcggcgucaugguguccaugaaagagccggggugguacucuuuuggauucgaaauuaaggauaagaaaugcgacgugccuuguaucgguauagagaugguccacgauggcgggaaggaaacuuggcauagcgccgcuaccgccauuuauugccugaugggaucaggccaguugcuaugggacacaguuaccgguguggauauggcacuguga

SEQ ID NO: 151538 - RNA, 1401 nt, Artificial Sequence; identical to SEQ ID NO: 150972
  derived and/or modified sequence opt3 from neuraminidase__InfluenzaB__AGX20683

SEQ ID NO: 151539 - RNA, 1401 nt, Artificial Sequence; identical to SEQ ID NO: 151135
  derived and/or modified sequence opt3 from neuraminidase__InfluenzaB__AGX20694

SEQ ID NO: 151540 - RNA, 1401 nt, Artificial Sequence
  derived and/or modified sequence opt3 from neuraminidase__InfluenzaB__AGX20705
augcugcccagcaccauccagacacucacucuuuuccugacguccggcgggguguuguuaucucuguacgucucagccagucuaagcuaucuccuguacuccgggauucuucugaaguuuucuccuaccgagauaacagcuccaacuaugccguuggacugcgcaaacgccucggauguucaagcggugaauagaucagcuaccaaagguguaacacuccugcugcccgaaccugaguggaccuauccaaggcucagcugucccggcaguacuuuccagaaggccuuacugaucuccccucaccgguuuggggaaacaaaaggaaacucugcaccacuuauuauccgcgagcccuucauugccugcggcccuaaugaauguaagcauuuugcuuugacccacuacgcagcccagccagguggguauuacaacggaacgcgaggcgaccguaauaaacugagacaucuaaucagcgugaagcucggcaagauaccgacugucgagaacuccaucuuccacauggcugccuggucagggagugcgugccaugauggaaaagaguggaccuauauugguguggacggccccgauaauaacgcacugcuuaagguuaaauacggggaagccuacacagacacuuaucacagcuacgcuaauaagauccugaggacccaggagucugccuguaacugcauuggaggcaauuguuauuugaugaucacagaugguuccgcaucaggggugagcgaaugccgguuucucaaaauacgcgagggaagaauuaucaaggagauuuucccuaccggcagggucaagcacacggaagaguguacuugcggcuuugcuaguaacaaaacaaucgaaugugccugccgggacaauucuuacaccgcgaagcgcccauucgugaaacugaacguagagacugauacagccgaaauccgauuaaugugcaccgacacguaucuggauacccccagaccuaaugacggguccauuacaggaccaugugagagcaacggugauaagggcucgggaggaauaaaaggcgguuuuguucaucaaaggauggagucuaagaucgggcggugguacucccguacuaugucaaaaaccgaacgcaugggcaugggacucuaugugaaguacgacggcgaccccugggcagauagugacgcucuuacauucagcggggucaugguguccaugaaggagccgggaugguacucuuuugguuucgaaauuaaagauaagaaaugcgacgugccuuguaucggcauagagaugguccacgaugggggaaaggaaacuuggcauagcgccgcuaccgccauuuauugccugaugggcucaggucaguugcuaugggacacaguuaccgggguggauauggcacuguga

SEQ ID NO: 151541 - RNA, 1401 nt, Artificial Sequence
  derived and/or modified sequence opt3 from neuraminidase__InfluenzaB__AGX20716
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggaucgagucucggauuggucguugguacucccgcacuaugucaaagaccgaaagaauggggaugggccucuaugugaaauacgacggagaucccugggcagacagugaugcucuugccuucagcggcgucaugguguccaugaaggagccggggugguacucuuuuggauucgaaaucaaggacaaaaagugcgaugugccuuguauagguauugagaugguccacgacggcgggaaagaaacauggcauagcgcugccacugcaaucuauugccugaugggaucaggccaguugcuaugggauaccguuacagguguggacauggcccuguga

SEQ ID NO: 151542 - RNA, 1401 nt, Artificial Sequence
  derived and/or modified sequence opt3 from neuraminidase__InfluenzaB__AGX20727
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccacaacugggccuugugagagcaauggagacaaggguucgggcgggauuaaaggaggcuucguucaucaaaggauggagucuaagauaggucggugguacucccguaccaugucaaaaacagaacgcauggggaugggccucuaugugaaguacgauggagacccaugggcagauagugacgcucuugccuuuagcggcgucaugguguccaugaaggagcccgggugguacucuuucggauucgaaaucaaagauaagaaaugcgacgugccguguauugguaucgagaugguccacgauggcgggaaggaaacuuggcauagcgcugccaccgcaauauauugccugaugggaucaggccaguugcuaugggacacaguuaccgguguggauauggcccuguga

SEQ ID NO: 151543 - RNA, 1401 nt, Artificial Sequence; identical to SEQ ID NO: 151135
  derived and/or modified sequence opt3 from neuraminidase__InfluenzaB__AGX20738

SEQ ID NO: 151544 - RNA, 1401 nt, Artificial Sequence; identical to SEQ ID NO: 150911
  derived and/or modified sequence opt3 from neuraminidase__InfluenzaB__AGX20749

SEQ ID NO: 151545 - RNA, 1401 nt, Artificial Sequence
  derived and/or modified sequence opt3 from neuraminidase__InfluenzaB__AGX20760
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggauggagucucggaucggucguugguacucccgcacuaugucaaagaccgaaagaauggggaugggccucuaugugaaauacgacggagaucccugggcagacagugaugcucuugccuucagcggcgucaugguguccaugaaggagccggggugguacucuuuuggauucgaaauuaaggacaaaaagugcgaugugccuuguaucgguauagagaugguccacgacggcgggaaagaaacauggcauagcgcugccacugcaauuuauugccugaugggaucaggccaguugcuaugggauaccguuacagguguggacauggcccuguga

SEQ ID NO: 151546 - RNA, 1401 nt, Artificial Sequence; identical to SEQ ID NO: 150911
  derived and/or modified sequence opt3 from neuraminidase__InfluenzaB__AGX20771

SEQ ID NO: 151547 - RNA, 1401 nt, Artificial Sequence
  derived and/or modified sequence opt3 from neuraminidase__InfluenzaB__AGX20782
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccucucauagguuuggcgaaacaaaagggaauagcgcaccucuuauuauccgggagccauucguggccugcggacccaacgaauguaagcacuuugcuuugacccauuacgcagcccagccuggcgguuauuacaaugggacgcgcggagaccgaaacaaacugcgucaccuaauuuccgucaagcucggcaagaucccaacuguggaaaauucaauauuccauauggcugccuggaguggcagcgcgugccacgaugggaaagaguggaccuauaucggaguugacgguccggauaacaaugcacugcuuaaggugaaauacggcgaggccuacacagacacuuaucacucuuacgcuaacaagauucugagaacccaggaguccgccuguaauugcaucgggggaaacuguuauuugaugauuacagauggcucagcaagcggugucagugaaugcagguuucucaaaauccgggaggggcgcauaauuaaggagaucuuccccaccggaagagugaagcauacggaagaguguacuugcggcuuugcuucuaauaaaacaauugaaugugccugcagggacaacuccuacaccgcgaagcggccuuucguaaaacugaauguugagacugauacagccgaaauccgcuuaaugugcaccgacacguaucuggauaccccacgacccaacgacggcagcaucacagggccuugugagucggauggagacaaggguucuggcgggauuaaaggaggcuuugugcaccaaagaauggaguccaagauagguaggugguacucacggacuaugagucguaccgaacgcauggggaugggccucuaugucaaauacgacggagauccaugggcagacagcgaugcucuugccuucuccggcgugauggugucuaugaaggagcccgggugguacagcuuuggauucgaaaucaaggacaaaaagugcgaugucccguguauugguaucgagaugguucaugacggcgggaaagaaacauggcacucagcugccacugcaauauauugccugaugggaaguggccaguugcuaugggauaccgugacagguguagacauggcccuguga

SEQ ID NO: 151548 - RNA, 1401 nt, Artificial Sequence
  derived and/or modified sequence opt3 from neuraminidase__InfluenzaB__AGX20793
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacaccucgaauguucaagccgugaacagaucagcgacaaaaggaguaaccuuccugcugccggaacccgaguggacuuauccuaggcucagcuguccagguaguacauuucagaaggcuuuacugaucucuccccaccgguucggcgaaaccaaaggaaauuccgccccucuuauuauccgcgagccauuuauugcaugcgggcccaacgaauguaagcauuucgccuugacgcacuacgcugcacagccuggcgguuauuacaaugggacucgaggagaccguaacaaacugagacaucuaaucagcgugaagcucggcaagauaccaaccgucgaaaauuccaucuuucacauggccgcuuggucaggcagugccugccaugaugggaaagaguggacauauauuggaguggacgguccggauaacgacgcgcugcuuaagguuaaauacggcgaggcauacacugauaccuaucacagcuacgccaauaagauccugaggacacaggagucugcuuguaacugcauugggggaaauuguuauuugaugaucaccgacggcuccgccucaggugugagcgaaugccgguuccucaaaauacgcgaggggagaauuaucaaggagauuuuucccacgggaagggucaagcacacugaagaguguacaugcggcuucgcaaguaacaaaaccaucgaaugugcuugccgggauaauucuuacacugccaagcgcccuuuugugaaacugaacguagagacagacaccgcggaaauccgauuaaugugcacggauaccuaucuggacacaccaagacccgaugacggcuccauuacugggccuugugagagcaauggagacaaggguucgggcgggauaaaaggaggcuucguucaucaaaggauggagucuaagaucggucggugguacucccguaccaugucaaaaacagaacgcauggggaugggccucuaugugaaguacgauggagacccaugggccgauagugacgcacuugcuuuuagcggcgucaugguguccaugaaggagcccgggugguacucuuucggauucgaaauuaaagauaagaaaugcgacgugccguguaucgguauagagaugguccacgauggcgggaaggaaacuuggcauagcgccgcuaccgccauuuauugccugaugggaucaggccaguugcuaugggacacaguuaccggugugaacauggcacuguga

SEQ ID NO: 151549 - RNA, 1401 nt, Artificial Sequence
  derived and/or modified sequence opt3 from neuraminidase__InfluenzaB__AGX20804
augcugcccagcaccauccagacacucacucuuuucauuacguccggcggggugcuguugucuuuauacgucucagcccugcuaaguuaucuccuguacagcgacauacuucugaaguuuuccccuaccgagaucacagcuccaacuaugucuuuggauugcgcaaacgccucgaauguucaagcggugaacagaucagcuaccaaaggaguaacauuccuccugccggaacccgaguggaccuauccuaggcugagcuguccagguaguacuuuucagaaggcccucuuaauuucuccccaccgguucggcgaaacaaaaggaaauuccgcaccucugaucauucgcgagccauuuaucgccugcgggcccaacgaauguaagcauuucgcucuuacccacuacgcagcccagccuggcgguuauuacaaugggacgcgaggagaccguaacaaauugagacaucugauaagcgugaagcuaggcaagaucccaacugucgaaaauuccauuuuucacauggcugccuggucaggcagugcgugccaugaugggaaagaguggaccuauaucggaguggacgguccggauaacgacgcacuccugaagguuaaauacggcgaggccuacacagauacuuaucacagcuacgcuaauaagauucuuaggacccaggagucugccuguaacugcaucgggggaaauuguuaucugaugauaacagacggcuccgcaucaggugugagcgaaugccgguucuugaaaauucgcgaggggagaaucauuaaggagaucuuucccaccggaagggucaagcacacggaagaguguacuugcggcuucgcuaguaacaaaacaaucgaaugugccugccgggauaauucuuacaccgcgaagcgcccuuuugugaaacucaacguagagacugacacagccgaaauucgacugaugugcaccgauacguauuuagacaccccaagacccgaugacggcuccauaacagggccuugugagagcaauggagacaaggguucgggcgggaucaaaggaggcuucguucaucaaaggauggagucuaagauuggucggugguacucccguacuaugucaaaaaccgaacgcauggggaugggccuguaugugaaguacgauggagacccaugggcagauagugacgcucucgccuuuagcggcgucaugguguccaugaaggagcccgggugguacucuuucggauucgaaaucaaagauaagaaaugcgacgugccguguauagguauugagaugguccacgauggcgggaaggaaacauggcauagcgcugccacugcaaucuauugccuuaugggaucaggccagcuguugugggacaccguuacagguguggauauggcccuauga

SEQ ID NO: 151550 - RNA, 1401 nt, Artificial Sequence; identical to SEQ ID NO: 150972
  derived and/or modified sequence opt3 from neuraminidase__InfluenzaB__AGX20815

SEQ ID NO: 151551 - RNA, 1401 nt, Artificial Sequence; identical to SEQ ID NO: 150972
  derived and/or modified sequence opt3 from neuraminidase__InfluenzaB__AGX20826

SEQ ID NO: 151552 - RNA, 1401 nt, Artificial Sequence; identical to SEQ ID NO: 150972
  derived and/or modified sequence opt3 from neuraminidase__InfluenzaB__AGX20837

SEQ ID NO: 151553 - RNA, 1401 nt, Artificial Sequence; identical to SEQ ID NO: 150972
  derived and/or modified sequence opt3 from neuraminidase__InfluenzaB__AGX20848

SEQ ID NO: 151554 - RNA, 1401 nt, Artificial Sequence
  derived and/or modified sequence opt3 from neuraminidase__InfluenzaB__AGX20870
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcaaagggaugggccuguauguuaaguacgacggagaacccuggaccgauagugacgcucucgccuuuagaggcgugauggucagcaugaaggagccggggugguacuccuucggauucgaaaucaaagauaagaaaugcgacgugccuuguauagguauugagauggugcaugauggcgggaaggaaacauggcacucugcugccacugcaaucuauugccuuaugggaagcggccaacuguugugggacaccgucacagguguugauauggcccuauga

SEQ ID NO: 151555 - RNA, 1401 nt, Artificial Sequence
  derived and/or modified sequence opt3 from neuraminidase__InfluenzaB__AGX20881
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggaaaccguaauaaauugagacaccugaucagcgugaagcuaggcaagauaccgacggucgagaacuccaucuuucauauggcugccuggucaggcagugcgugccacgacgggaaagaguggacuuauauuggaguggauggucccgacaauaacgcacuccugaagaucaaauacggcgaagccuacaccgauacauaucacagcuacgcuaauaacauucuuaggacucaggagucugccuguaauugcaucgggggaaacuguuaucugaugauaaccgacggcuccgcaucagguguuagcgaaugccgguucuugaagauucgcgaggggagaaucauuaaagagaucuuuccuacaggaagggugaagcauaccgaagaguguacgugcggcuucgcuaguaauaagacuaucgaaugugccugccgggauaacucuuacacagcgaaacgcccauuugucaagcucaacguggagaccgacacugccgaaauucgacugaugugcacagauaccuauuuagacacgcccagaccugaugacggcuccauaaccgggccaugugagagcaauggagauaaagguucgggcgggaucaagggaggcuucguacaccagaggauggcaucuaaaauuggucggugguacucccguacaaugucaaagacugagcgcaaagggaugggccuguauguuaaguacgacggagaccccuggaccgauagugacgcucucgccuuuagaggcgugauggucagcaugaaggaaccggggugguacuccuucggauucgagaucaaagauaagaaaugcgacgugccuuguauagguauugaaauggugcaugauggcgggaaggagacauggcacucugcugccacugcaaucuauugccuuaugggaagcggccaacuguugugggacaccgucacagguguugauauggcccuauga

SEQ ID NO: 151556 - RNA, 1401 nt, Artificial Sequence
  derived and/or modified sequence opt3 from neuraminidase__InfluenzaB__AGX20892
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaagcaaagggaaauuccgccccucuuauuauccgagagccauuuauugcuugcgggcccaacgaauguaaacauuucgcauugacacacuacgccgcucagccuggcgguuauuacaaugggacccguggagacagaaacaagcugaggcaucuaaucagcgugaaacucggcaagauaccaacggucgaaaauuccaucuuucacauggccgcguggucaggcagugcaugccaugaugggaaggaguggacuuauauuggaguggacgguccggauaacgacgcccugcuuaaaguuaaguacggcgaggcuuacaccgauacauaucacagcuacgccaauaaaauccugcggacucaggagucugcauguaacugcauugggggaaauuguuauuugaugaucaccgacggcuccgcuucaggugugagcgaaugccgcuuccucaagauaagagaggggaggauuaucaaagagauucugcccacaggacgggucaagcacaccgaagaguguacgugcggcuuugccaguaacaagacuaucgaaugugcgugccgcgauaauucuuacacagccaaacgaccuuucgugaaguuaaacguagagaccgacacugcagaaaucagacugaugugcacagauaccuaucucgacacgccaaggcccgaugacggcuccauuaccgggccuugugagagcaauggagacaaagguucgggcgggauaaagggaggcuuuguucaucaacggauggagucuaaaaucggucguugguacucccgcacaaugucaaagacugaaagaauggggaugggccuuuaugugaaauacgauggagacccaugggcugauagugacgcccuggcuuucagcggcgucaugguguccaugaaggagcccgggugguacucuuuuggauucgaaauuaaggauaaaaagugcgacgugccguguaucgguauagagaugguccacgauggcgggaaagaaaccuggcauagcgccgcaacagccauuuauugcuugaugggaucaggccagcuacugugggacacuguuaccgguguggauauggcucucuga

SEQ ID NO: 151557 - RNA, 1401 nt, Artificial Sequence; identical to SEQ ID NO: 150972
  derived and/or modified sequence opt3 from neuraminidase__InfluenzaB__AGX20903

SEQ ID NO: 151558 - RNA, 1401 nt, Artificial Sequence; identical to SEQ ID NO: 150972
  derived and/or modified sequence opt3 from neuraminidase__InfluenzaB__AGX20914

SEQ ID NO: 151559 - RNA, 1401 nt, Artificial Sequence
  derived and/or modified sequence opt3 from neuraminidase__InfluenzaB__AGX20925
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacaagaggggcgcauuaucaaggagauuuuucccaccggaagagucaagcacacggaagaguguacuugcggcuucgcuaguaacaaaacaaucgaaugugccugcagggauaauucuuacaccgcgaagcggccuuuugugaaacugaacguagagacugacacagccgaaauccgcuuaaugugcaccgauacguaucuggacaccccacgacccgaugacggcuccauuacagggccuugugagagcaauggagacaaggguucgggcgggauaaaaggaggcuucguucaucagagaauggagucuaagaucgguaggugguacucccggacuaugucaaaaaccgaacguauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguauagagaugguccacgauggcgggaaggaaacauggcauagcgcugccacugcaauuuauugccugaugggaucaggccaguugcuaugggacaccguuacagguguggauauggcccuguga

SEQ ID NO: 151560 - RNA, 1401 nt, Artificial Sequence
  derived and/or modified sequence opt3 from neuraminidase__InfluenzaB__AGX20936
augcugcccagcaccauccagacacucacucuuuuccugacguccggcgggguguuguuaucucuguacgucucagcccuacucaguuaucugcuuuacagcgacauucugccuaaguuuuccccaaccgagauaacagcuccgacuaugucuuuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaacgaauguaagcauuucgcucuuacccacuacgcagcccagccaggcgguuauuacaaugggacgcgaggagaccguaacaaauugagacaucugaucagcgugaagcuaggcaagauaccgacugucgaaaauuccaucuuucacauggcugccuggucaggcagugcgugccaugaugggaaagaguggaccuauauuggaguggacggucccgauaacgacgcacuccugaagguuaaauacggcgaggccuacacagauacuuaucacagcuacgcuaauaagauccuuaggacccaggagucugccuguaacugcauugggggaaauuguuaucugaugaucacagacggcuccgcaucaggugugagcgaaugccgguucuugaaaauacgcgaggggagaauuaucaaggagauuuuuccuaccggaagggucaagcacacggaagaguguacuugcggcuucgcuaguaacaaaacaaucgaaugugccugccgggauaauucuuacaccgcgaagcgcccauuugugaaacucaacguagagacugacacagccgaaauccgacugaugugcaccgauacguauuuagacacccccagaccugaugacggcuccauuacagggccaugugagagcaauggagacaaggguucgggcgggauaaaaggaggcuucguucaucaaaggauggagucuaagaucggucggugguacucccguacuaugucaaaaaccgaacgcauggggaugggccuguaugugaaguacgauggagaccccugggcagauagugacgcucucgucuuuagcggcgugaugguguccaugaaggagccggggugguacucuuucggauucgaaauuaaagauaagaaaugcgacgucccuuguaucgguauagagaugguucacgauggcgggaaggaaacauggcauagcgccgcuacugccauuuauugccuuaugggaucaggccagcuguugugggacaccgugacagguguagauauggcacuauga

SEQ ID NO: 151561 - RNA, 1401 nt, Artificial Sequence; identical to SEQ ID NO: 150911
  derived and/or modified sequence opt3 from neuraminidase__InfluenzaB__AGX20947

SEQ ID NO: 151562 - RNA, 1401 nt, Artificial Sequence
  derived and/or modified sequence opt3 from neuraminidase__InfluenzaB__AGX20958
augcugcccagcaccauccagacacucacucuuuuccugacguccggcgggguguuguuaucucuguacgucucagcccuacucaguuaucugcuuuacagcgacauucuguugaaguuuuccccuaccgagauaacaacuccaaccaugucucucgauugcacaaacgcuucgaauguucaagcagugaacagaucagccaccaaaggaguaacuuuccugcugccggaacccgaguggacauauccuaggcucagcuguccagguaguaccuuucagaaggcguuacugaucucuccccaccgguucggcgaaacgaaaggaaauuccgcuccucuuauuauccgcgagccauuuauugccugcgggcccaacgaauguaagcauuucgcauugacucacuacgccgcucagccuggcgguuauuacaaugggacccgaggagaccguaacaaacugagacaucuaaucagcgugaagcucggcaagauaccaacagucgaaaauuccaucuuucacauggcagccuggucaggcagugcuugccaugaugggaaagaguggacuuauauuggaguggacgguccggauaacgacgcccugcuuaagguuaaauacggcgaggcguacaccgauacauaucacagcuacgcaaauaagauccugaggacccaggagucugccuguaacugcauugggggaaauuguuauuugaugaucacggacggcuccgcuucaggugugagcgaaugccgguuccucaaaauacaagaggggcgcauuaucaaggagauuuuucccacuggaagagucaagcacacagaagaguguaccugcggcuucgccaguaacaaaacuaucgaaugugcaugcagggauaauucuuacacagcuaagcggccuuuugugaaacugaacguagagaccgacacggccgaaauccgcuuaaugugcaccgauacauaucuggacacuccacgacccgaugacggcuccauuaccgggccuugugagagcaauggagacaaggguucgggcgggauaaaaggaggcuucguucaucagagaauggagucuaagaucgguaggugguacucccggacaaugucaaaaacugaacguauggggaugggccucuaugugaaguacgauggagacccaugggcggauagugacgcccuugcauuuagcggcgucaugguguccaugaaggagcccgggugguacucuuucggauucgaaauuaaagauaagaaaugcgacgugccguguaucgguauagagaugguccacgauggcgggaaggaaaccuggcauagcgcugccacagcuauuuauugccugaugggaucaggccaguugcuaugggacaccguuacugguguggauauggcccuguga

SEQ ID NO: 151563 - RNA, 1401 nt, Artificial Sequence; identical to SEQ ID NO: 151135
  derived and/or modified sequence opt3 from neuraminidase__InfluenzaB__AGX20969

SEQ ID NO: 151564 - RNA, 1401 nt, Artificial Sequence; identical to SEQ ID NO: 151548
  derived and/or modified sequence opt3 from neuraminidase__InfluenzaB__AGX20980

SEQ ID NO: 151565 - RNA, 1401 nt, Artificial Sequence
  derived and/or modified sequence opt3 from neuraminidase__InfluenzaB__AGX20991
augcugcccagcaccauccagacacucacucuuuuccugacguccggcgggguguuguuaucucuguacgucucagcccuacucaguuaucugcuuuacagcgacauucugccuaaguuuuccccaaccgagauaacagcuccgacuaugucuuuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaacgaauguaagcauuucgcucuuacccacuacgcagcccagccaggcgguuauuacaaugggacgcgaggagaccguaacaaauugagacaucugaucagcgugaagcuaggcaagauaccgacugucgaaaauuccaucuuucacauggcugccuggucaggcagugcgugccaugaugggaaagaguggaccuauauuggaguggacggucccgauaacgacgcacuccugaagguuaaauacggcgaggccuacacagauacuuaucacagcuacgcuaauaagauccuuaggacccaggagucugccuguaacugcauugggggaaauuguuaucugaugaucacagacggcuccgcaucaggugugagcgaaugccgguucuugaaaauacgcaaggggagaauuaucaaggagauuuuuccuaccggaagggucaaacacacggaggaauguacuugcggcuucgcuaguaacaagacaaucgagugugccugccgggauaauucuuacaccgcgaaacgcccauuugugaagcucaacguagaaacugacacagccgagauccgacugaugugcaccgauacguauuuagacacccccagaccugaugacggcuccauuacagggccaugugaaagcaauggagacaaagguucgggcgggauaaagggaggcuucguucaucaaaggauggagucuaaaaucggucggugguacucccguacuaugucaaagaccgagcgcauggggaugggccuguaugugaaguacgauggagaccccugggcagauagugacgcucucgucuuuagcggcgugaugguguccaugaaagaaccggggugguacucuuucggauucgagauuaaggauaaaaagugcgacgucccuuguaucgguauagaaaugguucacgauggcgggaaagagacauggcauagcgccgcuacugccauuuauugccuuaugggaucaggccagcuguugugggacaccgugacagguguagauauggcacuauga

SEQ ID NO: 151566 - RNA, 1401 nt, Artificial Sequence; identical to SEQ ID NO: 150972
  derived and/or modified sequence opt3 from neuraminidase__InfluenzaB__AGX21002

SEQ ID NO: 151567 - RNA, 1401 nt, Artificial Sequence
  derived and/or modified sequence opt3 from neuraminidase__InfluenzaB__AGX21013
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccaauacguaucuggauaccccaagacccgacgauggcuccauuacagggccuugugagagcaacggagacaaggguucgggcgggauaaaaggaggcuucguucaucaaaggauggagucuaagaucggucggugguacucccguacuaugucaaaaaccgaacgcauggggaugggccucuaugugaaguacgacggagauccaugggcagacagugaugcucuugccuuuagcggcgucaugguguccaugaaggagcccgggugguacucuuucggauucgaaauuaaagacaagaaaugcgaugugccguguaucgguauagagaugguccacgacggcgggaaggaaacauggcauagcgcugccacugcaauuuauugccugaugggaucaggccaguugcuaugggauaccguuacagguguggacauggcccuguga

SEQ ID NO: 151568 - RNA, 1401 nt, Artificial Sequence
  derived and/or modified sequence opt3 from neuraminidase__InfluenzaB__AGX21024
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccuaaucgguuuggcgaaacaaaagggaacucugcaccacuuauuauccgcgagcccuucauugccugcggaccuaaugaauguaagcacuuugcuuugacccauuacgcagcccagccaggcgguuauuacaacgggacgcgaggagaccguaauaaacugagacaccuaaucagcgugaagcucggcaagauaccgacugucgagaacuccaucuuccauauggcugccuggucaggcagugcgugccacgaugggaaagaguggaccuauauuggaguggacggucccgauaauaacgcacugcuuaagguuaaauacggcgaagccuacacagacacuuaucauagcuacgcuaauaagauccugaggacccaggagucugccuguaacugcauugggggaaauuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaacaaaacaaucgaaugugccugccgggacaauucuuacaccgcgaagcgcccauucgugaaacugaacguagagacugauacagccgaaguucgauuaaugugcaccgacacguaucuggauacccccagaccuaacgacggcuccaucacagggccaugugagagcgauggagacaaggguucgggcgggauuaaaggaggcuuugugcaccaaaggauggagucuaagauaggucggugguacucccguacuaugucaaaaaccgaacgcauggggaugggccucuaugucaaguacgacggagaucccugggcagacagugaugcucuuacauucagcggcgugaugguguccaugaaggagccggggugguacucuuuuggauucgaaaucaaagacaagaaaugcgaugucccuuguauugguaucgagaugguucaugacggcgggaaggaaacuuggcacagcgccgcuaccgccauauauugccugaugggaucaggccaguugcuaugggauacagugaccgguguagacauggcacuguga

SEQ ID NO: 151569 - RNA, 1401 nt, Artificial Sequence; identical to SEQ ID NO: 150972
  derived and/or modified sequence opt3 from neuraminidase__InfluenzaB__AGX21035

SEQ ID NO: 151570 - RNA, 1401 nt, Artificial Sequence; identical to SEQ ID NO: 151135
  derived and/or modified sequence opt3 from neuraminidase__InfluenzaB__AGX21046

SEQ ID NO: 151571 - RNA, 1401 nt, Artificial Sequence; identical to SEQ ID NO: 151138
  derived and/or modified sequence opt3 from neuraminidase__InfluenzaB__AGX21057

SEQ ID NO: 151572 - RNA, 1401 nt, Artificial Sequence; identical to SEQ ID NO: 151556
  derived and/or modified sequence opt3 from neuraminidase__InfluenzaB__AGX21068

SEQ ID NO: 151573 - RNA, 1401 nt, Artificial Sequence
  derived and/or modified sequence opt3 from neuraminidase__InfluenzaB__AGX21079
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccucuaagauccugaggacucaggaguccgcauguaacugcauugggggaaauuguuauuugaugaucaccgauggcucagcuagcggugugagugaaugccgguuucucaaaauacgcgaggggagaauuaucaaggagauuuucccuacaggaagggucaagcacaccgaagaguguacgugcggcuuugccucuaacaaaacuaucgaaugugcgugccgggacaauuccuacacagccaagcgcccauucgugaaacugaacguagagaccgauacugcagaaauccgauuaaugugcacagacaccuaucuggauacgcccagaccuaaugacggcagcauuaccgggccaugugagucggauggagacaaggguucuggcgggauaaaaggaggcuuuguucaucaaaggauggaguccaagaucggucggugguacucacguacaaugaguaaaacugaacgcauggggaugggccucuaugugaaguacgacggagaucccugggcugacagcgaugcccuugcuuucuccggcgucauggugucuaugaaggagccggggugguacagcuuuggauucgaaauuaaagacaagaaaugcgaugugccuuguaucgguauagagaugguccacgacggcgggaaggaaaccuggcauucagccgcaacagccauuuauugccugaugggaaguggccaguugcuaugggauacuguuaccgguguggacauggcucuguga

SEQ ID NO: 151574 - RNA, 1401 nt, Artificial Sequence; identical to SEQ ID NO: 151138
  derived and/or modified sequence opt3 from neuraminidase__InfluenzaB__AGX21088

SEQ ID NO: 151575 - RNA, 1401 nt, Artificial Sequence; identical to SEQ ID NO: 151138
  derived and/or modified sequence opt3 from neuraminidase__InfluenzaB__AGX21099

SEQ ID NO: 151576 - RNA, 1401 nt, Artificial Sequence
  derived and/or modified sequence opt3 from neuraminidase__InfluenzaB__AGX21110
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagauucgcuaccaaaggaguaacauuucugcugccggaacccgaguggaccuauccuaggcucucauguccagguagcacuuuccagaaggccuuacugaucaguccccaccgguuuggcgaaacaaaaggaaauuccgcaccucuuauuauccgcgagccauucauugccugcgggcccaacgaauguaagcauuuugcuuugacccacuacgcagcccagccuggcgguuauuacaaugggacgcgaggagaccguaacaaacugagacaucuaaucucugugaagcucggcaagauaccaacugucgagaauagcaucuuccacauggcugccugguccggcucagcgugccaugaugggaaagaguggaccuauauuggaguggacgguccggauaacgacgcacugcuuaagguuaaauacggcgaagccuacacagauacuuaucacaguuacgcuaauaagauccugaggacccaggagagcgccuguaacugcauugggggaaauuguuauuugaugaucacagacggcucugcauccggugugucagaaugccgguuucucaaaauacgcgaggggagaauuaucaaggagauuuuccccaccggaagggucaagcacacggaagaguguacuugcggcuuugcuagcaacaaaacaaucgaaugugccugccgggauaauaguuacaccgcgaagcgcccuuucgugaaacugaacguagagacugacacagccgaaauccgauuaaugugcaccgauacguaucuggacaccccaagacccgaugacggcucuauuacagggccuugugaguccaauggagacaaggguagcggcgggauaaaaggaggcuuuguucaucaaaggauggagucgaagaucggucggugguacucucguacuauguccaaaaccgaacgcauggggaugggccucuaugugaaguacgauggagacccaugggcagauucagacgcucuugccuucaguggcgucauggugagcaugaaggagcccgggugguacuccuucggauuugaaauuaaagauaagaaaugcgacgugccguguaucgguauagagaugguccacgauggcgggaaggaaacauggcauucugcugccacugcaauuuauugccugaugggaagcggccaguugcuaugggacaccguuacagguguggauauggcccuguga

SEQ ID NO: 151577 - RNA, 1401 nt, Artificial Sequence
  derived and/or modified sequence opt3 from neuraminidase__InfluenzaB__AGX21121
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaccaaggagaucuuucccacgggaagggucaagcacacugaagaguguacaugcggcuucgcuaguaacaaaaccauugaaugugccugccgggauaauucuuacacugcgaagcgcccuuuugugaaacugaacguagagacagacaccgccgaaauccgauuaaugugcacggauaccuaucuggacacaccaagacccgaugacggcuccaucacugggccuugugagagcaauggagacaaggguucgggcgggauuaaaggaggcuucguucaucaaaggauggagucuaagauaggucggugguacucccguaccaugucaaaaacagaacgcauggggaugggccucuaugugaaguacgauggagacccaugggcagauagugacgcucuugccuuuagcggcgucaugguguccaugaaggagcccgggugguacucuuucggauucgaaaucaaagauaagaaaugcgacgugccguguauugguaucgagaugguccacgauggcgggaaggaaacuuggcauagcgcugccaccgcaauauauugccugaugggaucaggccaguugcuaugggacacaguuaccgguguggauauggcccuguga

SEQ ID NO: 151578 - RNA, 1401 nt, Artificial Sequence; identical to SEQ ID NO: 151135
  derived and/or modified sequence opt3 from neuraminidase__InfluenzaB__AGX21132

SEQ ID NO: 151579 - RNA, 1401 nt, Artificial Sequence; identical to SEQ ID NO: 150911
  derived and/or modified sequence opt3 from neuraminidase__InfluenzaB__AGX21143

SEQ ID NO: 151580 - RNA, 1401 nt, Artificial Sequence; identical to SEQ ID NO: 150972
  derived and/or modified sequence opt3 from neuraminidase__InfluenzaB__AGX21154

SEQ ID NO: 151581 - RNA, 1401 nt, Artificial Sequence
  derived and/or modified sequence opt3 from neuraminidase__InfluenzaB__AGX21165
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacauggagacugacacagccgaaauccgauuaaugugcaccgauacguaucuggacaccccaagacccgaugacggcuccauuacagggccuugugagagcaauggagacaaggguucgggcgggauaaaaggaggcuucguacaucaaaggauggagucuaagaucggucggugguacucccguacuaugucaaaaaccgaacgcauggggaugggccucuauguuaaguacgauggagacccaugggcagauagugacgcucuugccuuuagcggcgugauggucuccaugaaggagcccgggugguacucuuucggauucgaaauuaaagauaagaaaugcgacgugccguguaucgguauagagauggugcacgauggcgggaaggaaacauggcauagcgcugccacugcaauuuauugccugaugggaucaggccaguugcuaugggacaccgucacagguguugauauggcccuguga

SEQ ID NO: 151582 - RNA, 1401 nt, Artificial Sequence; identical to SEQ ID NO: 150972
  derived and/or modified sequence opt3 from neuraminidase__InfluenzaB__AGX21176

SEQ ID NO: 151583 - RNA, 1401 nt, Artificial Sequence
  derived and/or modified sequence opt3 from neuraminidase__InfluenzaB__AGX21187
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugugugccgggacaacucuuacaccgccaagcgcccauucguaaaacugaauguugagacugauacagcggaagugcgauuaaugugcaccgacacguaucuggauacccccagaccuaacgacggcuccaucacagggccaugugagagcgauggagacaaggguucgggcgggauuaaaggaggcuuuguccaucaaaggauggagucuaagauaggucggugguacucccguacuaugucaaaaaccgaacgcauggggaugggccucuaugugaaguacgacggagaucccugggccgacagugaugcacuuacauucagcggcgugauggucuccaugaaggagccggggugguacucuuuuggauucgaaaucaaagacaagaaaugcgauguuccuuguauugguaucgagauggugcacgacggcgggaaggaaacuuggcauagcgcugccaccgcuauauauugccugaugggaucaggccaguugcuaugggauacaguaaccgguguggacauggcccuguga

SEQ ID NO: 151584 - RNA, 1401 nt, Artificial Sequence
  derived and/or modified sequence opt3 from neuraminidase__InfluenzaB__AGX21198
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgaaccuaacgaguguaagcacuucgcucuuacacauuacgcagcccagccagggggcuauuacaaugguacccgaggggaccguaacaaauugagacaccugaucagcgugaagcuaggaaagauaccgacggucgaaaauuccaucuuucauauggcugccuggucaggcagugcgugccacgauggcaaagaguggacuuauauugggguggacggacccgauaacaaugcacuccugaagaucaaauacggugaggccuacaccgacacauaucacagcuacgcuaacaauauucuuaggacucaggaaucugccuguaacugcaucggcgggaauuguuaucugaugauaaccgauggauccgcaucaggcguuagcgagugccgguucuugaagauucgcgaggguagaaucauuaaagaaaucuuuccuacagggagggugaagcauaccgaggaauguacgugcggauucgcuaguaacaagacuaucgagugugccugccgggacaauucuuacacagcgaaacgcccauuugucaagcucaacguggaaaccgauacugccgagauucgacugaugugcacagacaccuauuuagauacgcccagaccugacgauggcuccauaaccggcccaugugagagcaacggggacaaaggaucggguggcaucaaagggggauucguacaccagaggauggcaucuaagauuggccggugguacucccguacaaugucaaagacugaacgcaaagguauggggcuguauguuaaguacgacggcgaucccuggaccgacagugaugcucucgccuuuagaggagugauggucagcaugaaggagccgggcugguacuccuucggguucgaaaucaaagacaagaaaugcgaugugccuuguauaggaauugagauggugcaugacgguggcaaggaaacauggcacucugcugccacugcaaucuauugccuuauggggagcggacaacuguugugggauaccgucacaggcguugacauggcccuauga

SEQ ID NO: 151585 - RNA, 1401 nt, Artificial Sequence; identical to SEQ ID NO: 150972
  derived and/or modified sequence opt3 from neuraminidase__InfluenzaB__AGX21209

SEQ ID NO: 151586 - RNA, 1401 nt, Artificial Sequence; identical to SEQ ID NO: 151135
  derived and/or modified sequence opt3 from neuraminidase__InfluenzaB__AGX21220

SEQ ID NO: 151587 - RNA, 1401 nt, Artificial Sequence
  derived and/or modified sequence opt3 from neuraminidase__InfluenzaB__AGX21231
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaaagcgaguggaccuaucccaggcucaguuguccugguuccacuuuucagaaggccuuacugaucucuccacaccgguucggcgaaacaaaagggaauagcgcaccccuuauuauccgcgagccuuuuauugccugcggaccaaacgaauguaagcauuucgcuuugacccacuacgcagcccagcccggcgguuauuacaaugggacgcgaggagaccguaacaaacugagacaucuaaucuccgugaagcucggcaagauaccuacugucgaaaauucaaucuuucacauggcugccuggaguggcagcgcgugccaugaugggaaagaguggaccuauauuggaguggacgguccagauaacgacgcacugcuuaagguuaaauacggcgaggccuacacagauacuuaucacucuuacgcuaauaagauccugaggacccaggaguccgccuguaacugcauugggggaaauuguuauuugaugaucacagacggcucagcaagcggugugagugaaugccgguuccucaaaauacgcgaggggagaauuaucaaggagauuuuuccgaccggaagggucaagcacacggaagaguguacuugcggcuucgcuucuaacaaaacaaucgaaugugccugccgggauaauuccuacaccgcgaagcgccccuuugugaaacugaacguagagacugacacagccgaaauccgauuaaugugcaccgauacguaucuggacaccccuagaccagaugacggcagcauuacagggcccugugagucgaauggagacaaggguucuggcgggauaaaaggaggcuucguucaucaaaggauggaguccaagaucggucggugguacucacguacuaugaguaaaaccgaacgcauggggaugggccucuaugugaaguacgauggagacccuugggcagauagcgacgcucuugccuuuuccggcgucauggugucuaugaaggagccagggugguacagcuucggauucgaaauuaaagauaagaaaugcgacgugcccuguaucgguauagagaugguccacgauggcgggaaggaaacauggcauucagcugccacugcaauuuauugccugaugggaaguggccaguugcuaugggacaccguuacagguguggauauggcccuguga

SEQ ID NO: 151588 - RNA, 1401 nt, Artificial Sequence; identical to SEQ ID NO: 151138
  derived and/or modified sequence opt3 from neuraminidase__InfluenzaB__AGX21242

SEQ ID NO: 151589 - RNA, 1401 nt, Artificial Sequence; identical to SEQ ID NO: 150972
  derived and/or modified sequence opt3 from neuraminidase__InfluenzaB__AGX21253

SEQ ID NO: 151590 - RNA, 1401 nt, Artificial Sequence
  derived and/or modified sequence opt3 from neuraminidase__InfluenzaB__AGX21264
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaauaaagggaacuccgcaccucuuauuauccgcgagccauucauugccugcggacccaaugaauguaagcauuuugcuuugacccacuacgcagcccagccuggcgguuauuacaacgggacgcgaggagaccguaauaaacugagacaucuaaucagcgugaagcucggcaagauaccaacugucgagaacuccaucuuccacauggcugccuggucaggcagugcgugccaugaugggaaagaguggaccuauauuggaguggacgguccggauaauaacgcacugcuuaagguuaaauacggcgaagccuacacagacacuuaucacagcuacgcuaauaagauccugaggacccaggagucugccuguaacugcauugggggaaauuguuauuugaugaucacagauggcuccgcaucaggugugagcgaaugccgguuucucaaaauacgcgaggggagaauuaucaaggagauuuuccccaccggaagggucaagcacacggaagaguguacuugcggcuuugcuaguaacaaaacaaucgaaugugccugccgggacaauucuuacaccgcgaagcgcccuuucgugaaacugaacguagagacugauacagccgaaauccgauuaaugugcaccgacacguaucuggauaccccaagacccaacgacggcuccauuacagggccuugugagagcgauggagacaaggguucgggcgggauaaaaggaggcuuuguucaucaaaggauggagucuaagaucggucggugguacucccguacuaugucaaaaaccgaacgcauggggaugggccucuaugugaaguacgacggagauccaugggcagacagugaugcucuugccuucagcggcgucaugguguccaugaaggagcccucuugguacagcuuuggguucgaaauuaaagacaagaaaugcgaugugccguguaucggaauagagaugguccacgacgguggcaaggaaacauggcauucagcugccacugcaauuuauugccugauggggaguggacaguugcuaugggauaccguuacaggcguggacauggcccuguga

SEQ ID NO: 151591 - RNA, 1401 nt, Artificial Sequence; identical to SEQ ID NO: 150911
  derived and/or modified sequence opt3 from neuraminidase__InfluenzaB__AGX21275

SEQ ID NO: 151592 - RNA, 1401 nt, Artificial Sequence; identical to SEQ ID NO: 150972
  derived and/or modified sequence opt3 from neuraminidase__InfluenzaB__AGX21286

SEQ ID NO: 151593 - RNA, 1401 nt, Artificial Sequence
  derived and/or modified sequence opt3 from neuraminidase__InfluenzaB__AGX21297
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugacuggaccuauccaaggcucagcugucccgguaguacuuuccagaaggccuuacugaucuccccucaccgguuuggcgagacaaaaggaaauucugcaccacuuauuauccgcgaacccuucauugccugcgggccuaacgaguguaagcauuuugcuuugacccacuacgcagcccagccaggcgguuauuacaaugggacgcgaggagaucguaacaaacugagacaucuaaucagcgugaagcucggcaagauaccgacugucgaaaauuccaucuuccacauggcugccuggucaggcagugcgugccaugacgggaaagaguggaccuauauuggaguggauggucccgacaacaaugcacugcuuaagguuaaauacggcgaggccuacacagauacuuaucacagcuacgcuaacaagauccugaggacccaggaaucugccuguaauugcauugggggaaacuguuauuugaugaucacagacggcuccgcaucaggugugagcgagugccgguuucucaaaauacgcgaagggagaauuaucaaggagauuuucccuaccggaagggucaagcacacggaggaauguacuugcggcuuugcuaguaauaaaacaaucgagugugccugccgggauaacucuuacaccgcgaagcgcccauucgugaaacugaauguagaaacugacacagccgagguucgauuaaugugcaccgauacguaucuggacacccccagaccuaacgauggcuccaucacagggccaugugaaagcgacggagacaaggguucgggcgggauuaaaggaggcuuugugcaucaaaggauggagucuaagauaggucggugguacucccguacuaugucaaaaaccgagcgcauggggaugggccucuaugucaaguacgauggagaccccugggcagauagugacgcucuuacauucagcggcgugaugguguccaugaaggaaccggggugguacucuuuuggauucgagaucaaagauaagaaaugcgacgucccuuguauugguaucgaaaugguucacgauggcgggaaggagacuuggcauagcgccgcuaccgccauauauugccugaugggaucaggccaguugcuaugggacacagugaccgguguagauauggcacuguga

SEQ ID NO: 151594 - RNA, 1401 nt, Artificial Sequence
  derived and/or modified sequence opt3 from neuraminidase__InfluenzaB__AGX21308
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcaaagggaugggccuguauguuaaguacgacggagaucccuggaccgacagugaugcucucgcccuuagaggcgugauggucagcaugaaggaaccggggugguacuccuuuggauucgagaucaaagacaagaaaugcgaugugccuuguauagguauugaaauggugcaugacggcgggaaggagacauggcacucugcugccacugcaaucuauugccugaugggaagcggccaauugcuaugggauaccgucacagguguugacauggcccuguga

SEQ ID NO: 151595 - RNA, 1401 nt, Artificial Sequence; identical to SEQ ID NO: 150916
  derived and/or modified sequence opt3 from neuraminidase__InfluenzaB__AGX21319

SEQ ID NO: 151596 - RNA, 1401 nt, Artificial Sequence; identical to SEQ ID NO: 150911
  derived and/or modified sequence opt3 from neuraminidase__InfluenzaB__AGX21330

SEQ ID NO: 151597 - RNA, 1401 nt, Artificial Sequence; identical to SEQ ID NO: 150911
  derived and/or modified sequence opt3 from neuraminidase__InfluenzaB__AGX21341

SEQ ID NO: 151598 - RNA, 1401 nt, Artificial Sequence; identical to SEQ ID NO: 151138
  derived and/or modified sequence opt3 from neuraminidase__InfluenzaB__AGX21352

SEQ ID NO: 151599 - RNA, 1401 nt, Artificial Sequence
  derived and/or modified sequence opt3 from neuraminidase__InfluenzaB__AGX21363
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccucucaccgguuuggcgaaacaaaagggaauagcgcaccucuuauuauccgcgagccauucguggccugcggacccaacgaauguaagcauuuugcuuugacccacuacgcagcccagccuggcgguuauuacaaugggacgcgaggagaccguaacaaacugagacaucuaauuuccgucaagcucggcaagaucccaacuguggaaaauucaauauuccacauggcugccuggaguggcagcgcgugccaugaugggaaagaguggaccuauaucggaguugacgguccggauaacaaugcacugcuuaaggugaaauacggcgaggccuacacagacacuuaucacucuuacgcuaacaagauucugaggacccaggaguccgccuguaauugcaucgggggaaacuguuauuugaugauuacagauggcucagcaagcggugucagugaaugccgguuucucaaaauccgcgaggggagaauaauuaaggagaucuuccccaccggaagggugaagcacacggaagaguguacuugcggcuuugcuucuaauaaaacaauugaaugugccugccgggacaacuccuacaccgcgaagcgcccuuucguaaaacugaauguugagacugauacagccgaaauccgauuaaugugcaccgacacguaucuggauaccccaagacccaacgacggcagcaucacagggccuugugagucggauggagacaaggguucuggcgggauuaaaggaggcuuugugcaucaaaggauggaguccaagauaggucggugguacucacguacuaugaguaaaaccgaacgcauggggaugggccucuaugucaaguacgacggagauccaugggcagacagcgaugcucuugccuucuccggcgugauggugucuaugaaggagcccgggugguacagcuuuggauucgaaaucaaagacaagaaaugcgaugucccguguauugguaucgagaugguucacgacggcgggaaggaaacauggcauucagcugccacugcaauauauugccugaugggaaguggccaguugcuaugggauaccgugacagguguagacauggcccuguga

SEQ ID NO: 151600 - RNA, 1401 nt, Artificial Sequence; identical to SEQ ID NO: 150911
  derived and/or modified sequence opt3 from neuraminidase__InfluenzaB__AGX21374

SEQ ID NO: 151601 - RNA, 1401 nt, Artificial Sequence; identical to SEQ ID NO: 150972
  derived and/or modified sequence opt3 from neuraminidase__InfluenzaB__AGX21385

SEQ ID NO: 151602 - RNA, 1401 nt, Artificial Sequence; identical to SEQ ID NO: 150972
  derived and/or modified sequence opt3 from neuraminidase__InfluenzaB__AGX21396

SEQ ID NO: 151603 - RNA, 1401 nt, Artificial Sequence; identical to SEQ ID NO: 150911
  derived and/or modified sequence opt3 from neuraminidase__InfluenzaB__AGX21407

SEQ ID NO: 151604 - RNA, 1401 nt, Artificial Sequence; identical to SEQ ID NO: 150911
  derived and/or modified sequence opt3 from neuraminidase__InfluenzaB__AGX21418

SEQ ID NO: 151605 - RNA, 1401 nt, Artificial Sequence
  derived and/or modified sequence opt3 from neuraminidase__InfluenzaB__AGX21429
augcugcccagcaccauccagacacucacucuuuuccugacguccggcgggguguuguuaucucuguacgucucagcccuacucaguuaucugcuucacagcgacauucuguugaaguuuuccccuaccgagauaacagcuccaacuaugucucucgauugcgcaaacgccucgaauguucaagcggugaacagaucaguaaccaaaggagugacauuccugcugccggaacccgaguggaccuacccuaggcucagcuguccagguaguacuuuucagaaggcuuuacugaucucuccccaucgguucggcgaaacaaaaggaaauuccgccccucuuauuauccgcgagccauuuauugcaugcgggcccaacgaauguaagcacuucgccuugacccauuaugcugcacagccuggcgguuacuauaaugggacgcgaggagaccguaacaaacugagacaccuaaucagcgucaagcucggcaagauaccaacuguggaaaauuccaucuuucauauggccgcuuggucaggcagugccugccacgaugggaaagaguggaccuacauuggaguugacgguccggauaacgacgcgcugcuuaaggugaaauauggcgaggcauacacagauacuuaccacagcuaugccaauaagauccugaggacccaggagucugcuuguaacugcauugggggaaauuguuacuugaugaucacagacggcuccgccucaggugucagcgaaugccgguuccucaaaauacgcgaggggagaauuaucaaggagauuuuucccaccggaagggugaagcauacggaagaguguacuugcggcuucgcaaguaacaaaacaaucgaaugugcuugccgggauaauucuuauaccgccaagcgcccuuuuguaaaacugaacguugagacugacacagcggaaauccgauuaaugugcaccgauacguaccuggacaccccaagacccgaugacggcuccauuacagggccuugugagagcaauggagacaaggguucgggcgggauaaaaggaggcuucgugcaccaaaggauggagucuaagaucggucggugguauucccguacuaugucaaaaaccgaacgcauggggaugggccucuacgucaaguaugauggagacccaugggccgauagugacgcacuugcuuuuagcggcgugaugguguccaugaaggagcccgggugguacucuuucggauucgaaauuaaagauaagaaaugcgacgucccguguaucgguauagagaugguucaugauggcgggaaggaaacauggcacagcgccgcuacugccauuuacugccugaugggaucaggccaguugcuaugggacaccgugacagguguagauauggcacuguga

SEQ ID NO: 151606 - RNA, 1401 nt, Artificial Sequence; identical to SEQ ID NO: 150972
  derived and/or modified sequence opt3 from neuraminidase__InfluenzaB__AGX21440

SEQ ID NO: 151607 - RNA, 1401 nt, Artificial Sequence; identical to SEQ ID NO: 150972
  derived and/or modified sequence opt3 from neuraminidase__InfluenzaB__AGX21451

SEQ ID NO: 151608 - RNA, 1401 nt, Artificial Sequence; identical to SEQ ID NO: 151556
  derived and/or modified sequence opt3 from neuraminidase__InfluenzaB__AGX21462

SEQ ID NO: 151609 - RNA, 1401 nt, Artificial Sequence
  derived and/or modified sequence opt3 from neuraminidase__InfluenzaB__AGX21473
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaagcaaagggaaauuccgccccucuuauuauccgagagccauuuauugcuugcgggcccaacgaauguaaacauuucgcauugacacacuacgccgcucagccuggcgguuauuacaaugggacccguggagacagaaacaagcugaggcaucuaaucagcgugaaacucggcaagauaccaacggucgaaaauuccaucuuucacauggccgcguggucaggcagugcaugccaugaugggaaggaguggacuuauauuggaguggacgguccggauaacgacgcccugcuuaaaguuaaguacggcgaggcuuacaccgauacauaucacagcuacgccaauaaaauccugcggacucaggagucugcauguaacugcauugggggaaauuguuauuugaugaucaccgacggcuccgcuucaggugugagcgaaugccgcuuccucaagauaagagaggggaggauuaucaaagagauucugcccacaggacgggucaagcacaccgaagaguguacgugcggcuuugccaguaacaagacuaucgaaugugcgugccgcgauaauucuuacacagccaaacgaccuuucgugaaguuaaacguagagaccgacacugcagaaaucagacugaugugcacagauaccuaucucgacacgccaaggcccgaugacggcuccauuaccgggccuugugagagcaauggagacaaagguucgggcgggauaaagggaggcuuuguucaucaacggauggagucuaaaaucggucguugguacucccgcacaaugucaaagacugaaagaauggggaugggccuuuaugugaaauacgauggagacccaugggcugauagugacgcccuggucuucagcggcgugaugguguccaugaaggagcccgggugguacucuuuuggauucgaaauuaaggauaaaaagugcgacgucccguguaucgguauagagaugguucacgauggcgggaaagaaaccuggcauagcgcugccacagcaauuuauugcuugaugggaucaggccagcuacugugggacacugugaccgguguagauauggcccucuga

SEQ ID NO: 151610 - RNA, 1401 nt, Artificial Sequence; identical to SEQ ID NO: 150916
  derived and/or modified sequence opt3 from neuraminidase__InfluenzaB__AGX21484

SEQ ID NO: 151611 - RNA, 1401 nt, Artificial Sequence; identical to SEQ ID NO: 150972
  derived and/or modified sequence opt3 from neuraminidase__InfluenzaB__AGX21495

SEQ ID NO: 151612 - RNA, 1401 nt, Artificial Sequence; identical to SEQ ID NO: 150972
  derived and/or modified sequence opt3 from neuraminidase__InfluenzaB__AGX21506

SEQ ID NO: 151613 - RNA, 1401 nt, Artificial Sequence
  derived and/or modified sequence opt3 from neuraminidase__InfluenzaB__AGX21517
augcugcccagcaccauccagacacucacucuuuuccugacguccggcgggguguuguuaucucuguacgucucagcccuacucaguuaucugcuuuacagcaacauucuguugaaguuuuccccuaccgagauaacagcuccaacuaugucucucgacugcgcaaaugccucgaacguucaagcggugaauagaucagcuaccaaaggaguaacauuccugcugccggaacccgaguggaccuauccuaggcucagcuguccagguaguacuuuucagaaggccuuacugaucucuccccaccgguucggcgaaacaaaagggaacuccgcaccucuuauuauccgcgagccauuuauugccugcggacccaaugaauguaagcauuucgcuuugacccacuacgcagcccagccuggcgguuauuacaacgggacgcgaggagaucguaauaaacugagacaucuaaucagcgugaagcucggcaagauaccaacugucgagaacuccaucuuucacauggcugccuggucaggcagugcgugccaugacgggaaagaguggaccuauauuggaguggaugguccggacaaugaugcacugcuuaagguuaaauacggcgaagccuacacagacacuuaucacagcuacgcuaacaagauccugaggacccaggagucugccuguaauugcauugggggaaacuguuauuugaugaucacagauggcuccgcaucaggugugagcgaaugccgguuccucaaaauacgcgaggggagaauuaucaaggagauuuuucccaccggaagggucaagcacacggaagaguguacuugcggcuucgcuaguaauaaaacaaucgaaugugccugccgggacaacucuuacaccgcgaagcgcccuuuugugaaacugaauguagagacugauacagccgaaauccgauuaaugugcaccgacacguaucuggauaccccaagacccgacgauggcuccauuacagggccuugugagagcaacggagacaaggguucgggcgggauaaaaggaggcuucguucaucaaaggauggagucuaagaucggucggugguacucccguacuaugucaaaaaccgaacgcauggggaugggccucuaugugaaguacgacggagauccaugggcagacagugaugcucuugccuuuagcggcgucaugguguccaugaaggagcccgggugguacucuuucggauucgaaauuaaagacaagaaaugcgaugugccguguaucgguauagagaugguccacgacggcgggaaggaaacauggcauagcgcugccacugcaauuuauugccugaugggaucaggccaguugcuaugggauaccguuacagguguggacauggcccuguga

SEQ ID NO: 151614 - RNA, 1401 nt, Artificial Sequence
  derived and/or modified sequence opt3 from neuraminidase__InfluenzaB__AGX21528
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaguucgauuaaugugcaccgacacguaucuggauacccccagaccuaacgacggcuccaucacagggccaugugagagcgauggagacaaggguucgggcgggauuaaaggaggcuuugugcaucaaaggauggagucuaagauaggucggugguacucccguacuaugucaaaaaccgaacgcauggggaugggccucuaugucaaguacgacggagaucccugggcagacagugaugcucuuacauucagcggcgugaugguguccaugaaggagccggggugguacucuuuuggauucgaaaucaaagacaagaaaugcgaugucccuuguauugguaucgagaugguucacgacagcggcaaggaaacuuggcauucagccgcuaccgccauauauugccugauggggaguggacaguugcuaugggauacagugaccggcguagacauggcacuguga

SEQ ID NO: 151615 - RNA, 1401 nt, Artificial Sequence; identical to SEQ ID NO: 150972
  derived and/or modified sequence opt3 from neuraminidase__InfluenzaB__AGX21539

SEQ ID NO: 151616 - RNA, 1401 nt, Artificial Sequence
  derived and/or modified sequence opt3 from neuraminidase__InfluenzaB__AGX21550
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccugcuggaagggucaagcacaccgaagaguguacgugcggcuuugccaguaauaaaacuaucgaaugugcgugccgggacaacucuuacacagccaagcgcccauucgugaaacugaauguagagaccgauacugcagaaguucgauuaaugugcacagacaccuaucuggauacgcccagaccuaacgacggcuccaucaccgggccaugugagagcgauggagacaaggguucgggcgggauuaaaggaggcuuugugcaucaaaggauggagucuaagauaggucggugguacucccguacaaugucaaaaacugaacgcauggggaugggccucuaugucaaguacgacggagaucccugggcugacagugaugcccuuaccuucagcggcgugaugguguccaugaaggagccggggugguacucuuuuggauucgaaaucaaagacaagaaaugcgaugucccuuguauugguaucgagaugguucacgacggcgggaaggaaacauggcauagcgcugccacugcaauauauugccugaugggaucaggccaguugcuaugggauaccgugacagguguagacauggcccuguga

SEQ ID NO: 151617 - RNA, 1401 nt, Artificial Sequence
  derived and/or modified sequence opt3 from neuraminidase__InfluenzaB__AGX21561
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaguccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaagugcgauuaaugugcaccgacacguaucuggauacccccagaccuaacgacggcuccaucacagggccaugugagagcgauggagacaaggguucgggcgggaucaaaggaggcuuuguccaucaaaggauggagucuaagauuggucggugguacucccguacuaugucaaaaaccgaacgcauggggaugggccucuaugugaaguacgacggagaucccugggcagacagugaugcucuuacauucagcggcgugauggucuccaugaaggagccggggugguacucuuuuggauucgaaauaaaagacaagaaaugcgauguuccuuguaucgguauugagauggugcacgacggcgggaaggaaacuuggcauagcgccgcuaccgccaucuauugccugaugggaucaggccaguugcuaugggauacaguaaccgguguggacauggcacuguga

SEQ ID NO: 151618 - RNA, 1401 nt, Artificial Sequence; identical to SEQ ID NO: 150916
  derived and/or modified sequence opt3 from neuraminidase__InfluenzaB__AGX21572

SEQ ID NO: 151619 - RNA, 1401 nt, Artificial Sequence
  derived and/or modified sequence opt3 from neuraminidase__InfluenzaB__AGX21583
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaagcaaagggaaauuccgccccucuuauuauccgagagccauuuauugcuugcgggcccaacgaauguaaacauuucgcauugacacacuacgccgcucagccuggcgguuauuacaaugggacccguggagacagaaacaagcugaggcaucuaaucagcgugaaacucggcaagauaccaacggucgaaaauuccaucuuucacauggccgcguggucaggcagugcaugccaugaugggaaggaguggacuuauauuggaguggacgguccggauaacgacgcccugcuuaaaguuaaguacggcgaggcuuacaccgauacauaucacagcuacgccaauaaaauccugcggacucaggagucugcauguaacugcauugggggaaauuguuauuugaugaucaccgacggcuccgcuucaggugugagcgaaugccgcuuccucaagauaagagaggggaggauuaucaaagagauucugcccacaggacgggucaagcacaccgaagaguguacgugcggcuuugccaguaacaagacuaucgaaugugcgugccgcgauaauucuuacacagccaaacgaccuuucgugaaguuaaacguagagaccgacacugcagaaaucagacugaugugcacagauaccuaucucgacacgccaaggcccgaugacggcuccauuaccgggccuugugagagcaauggagacaaagguucgggcgggauaaagggaggcuuuguucaucaacggauggagucuaaaaucggucguugguacucccgcacaaugucaaagacugaaagaauggggauggagcuuuaugugaaauacgauggcgacccaugggcugauagugacgcccuggcuuucagcggagucaugguguccaugaaggaacccggcugguacucuuuuggguucgagauuaaggauaaaaagugcgacgugccguguaucggaauagaaaugguccacgaugguggcaaagagaccuggcauagcgccgcaacagccauuuauugcuugauggggucaggacagcuacugugggacacuguuaccggcguggauauggcucucuga

SEQ ID NO: 151620 - RNA, 1401 nt, Artificial Sequence; identical to SEQ ID NO: 150916
  derived and/or modified sequence opt3 from neuraminidase__InfluenzaB__AGX21594

SEQ ID NO: 151621 - RNA, 1401 nt, Artificial Sequence; identical to SEQ ID NO: 151138
  derived and/or modified sequence opt3 from neuraminidase__InfluenzaB__AGX21605

SEQ ID NO: 151622 - RNA, 1401 nt, Artificial Sequence
  derived and/or modified sequence opt3 from neuraminidase__InfluenzaB__AGX21615
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugaucucuccccaccgguuuggcgaaaauaaagggaacuccgcaccucuuauuauccgcgagccauucauugccugcggacccaaugaauguaagcauuuugcuuugacccacuacgcagcccagccuggcgguuauuacaacgggacgcgaggagaccguaauaaacugagacaucuaaucagcgugaagcucggcaagauaccaacugucgagaacuccaucuuccacauggcugccuggucaggcagugcgugccaugaugggaaagaguggaccuauauuggaguggacgguccggauaauaacgcacugcuuaagguuaaauacggcgaagccuacacagacacuuaucacagcuacgcuaauaagauccugaggacccaggagucugccuguaacugcauugggggaaauuguuauuugaugaucacagauggcuccgcaucaggugugagcgaaugccgguuucucaaaauacgcgaggggagaauuaucaaggagauuuuccccaccggaagggucaagcacacggaagaguguacuugcggcuuugcuaguaacaaaacaaucgaaugugccugccgggacaauucuuacaccgcgaagcgcccuuucgugaaacugaacguagagacugauacagccgaaauccgauuaaugugcaccgacacguaucuggauaccccaagacccaacgacggcuccauuacagggccuugugagagcgauggagacaaggguucgggcgggauaaaaggaggcuuuguucaucaaaggauggagucuaagaucggucggugguacucccguacuaugucaaaaaccgaacgcauggggaugggccucuaugugaaguacgacggagauccaugggcagacagugaugcucuugccuucagcggcgucaugguguccaugaaggagcccgggugguacucuuuuggauucgaaauuaaagacaagaaaugcgaugugccguguaucgguauagagaugguccacgacggcgggaaggaaacauggcauagcgcugccacugcaauuuauugccugaugggaucaggccaguugcuaugggauaccguuacagguguggacauggcccuguga

SEQ ID NO: 151623 - RNA, 1401 nt, Artificial Sequence; identical to SEQ ID NO: 150972
  derived and/or modified sequence opt3 from neuraminidase__InfluenzaB__AGX21626

SEQ ID NO: 151624 - RNA, 1401 nt, Artificial Sequence; identical to SEQ ID NO: 150972
  derived and/or modified sequence opt3 from neuraminidase__InfluenzaB__AGX21637

SEQ ID NO: 151625 - RNA, 1401 nt, Artificial Sequence; identical to SEQ ID NO: 150972
  derived and/or modified sequence opt3 from neuraminidase__InfluenzaB__AGX21648

SEQ ID NO: 151626 - RNA, 1401 nt, Artificial Sequence
  derived and/or modified sequence opt3 from neuraminidase__InfluenzaB__AGX21659
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuagugagcgucaagcucggcaagaucccaacuguggaaaauuccauauuucacauggcugccuggucaggcagugcgugccaugaugggaaagaguggaccuauaucggaguugacgguccggauaacgacgcacugcuuaaggugaaauacggcgaggccuacacagauacuuaucacagcuacgcuaauaagauucugaggacccaggagucugccuguaacugcaucgggggaaauuguuauuugaugauuacagacggcuccgcaucaggugucagcgaaugccgguuccucaaaauccgcgaggggagaauaauuaaggagaucuuucccaccggaagggugaagcacacggaagaguguacuugcggcuucgcuaguaacaaaacaauugaaugugccugccgggauaauucuuacaccgcgaagcgcccuuuuguaaaacugaacguugagacugacacagccgaaauccgauuaaugugcaccgauacguaucuggacaccccaagacccgaugacggcuccaucacagggccuugugagagcaauggagacaaggguucgggcgggauuaaaggaggcuucgugcaucaaaggauggagucuaagauaggucggugguacucccguacuaugucaaaaaccgaacgcauggggaugggccucuaugucaaguacggaggcgauccaugggcagacagugaugcucuugccuuuagcggggugaugguguccaugaaggagcccggaugguacucuuucgguuucgaaaucaaagacaagaaaugcgaugucccguguauuggcaucgagaugguucacgacgggggaaaggaaacauggcauagcgcugccacugcaauauauugccugaugggcucaggucaguugcuaugggauaccgugacagggguagacauggcccuguga

SEQ ID NO: 151627 - RNA, 1401 nt, Artificial Sequence
  derived and/or modified sequence opt3 from neuraminidase__InfluenzaB__AGX21670
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguacagagaugguccacgauggcgggaaggaaacuuggcauagcgcugccaccgcaauauauugccugaugggaucaggccaguugcuaugggacacaguuaccgguguggauauggcccuguga

SEQ ID NO: 151628 - RNA, 1401 nt, Artificial Sequence
  derived and/or modified sequence opt3 from neuraminidase__InfluenzaB__AGX21681
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguaauggcgggaucaagggaggcuucguacaccagaggauggcaucgaaaauuggucggugguacucucguacaauguccaagacugagcgcaaagggaugggccuguauguuaaguacgacggagaucccuggaccgacucagaugcucucgccuuuagaggcgugauggucaguaugaaggaaccggggugguacagcuucggauucgagaucaaagacaagaaaugcgaugugccuuguauagguauugaaauggugcaugacggcgggaaggagacauggcacuccgcugccacugcaaucuauugccuuaugggaucuggccaacuguugugggauaccgucacagguguugacauggcccuauga

SEQ ID NO: 151629 - RNA, 1401 nt, Artificial Sequence; identical to SEQ ID NO: 150911
  derived and/or modified sequence opt3 from neuraminidase__InfluenzaB__AGX21692

SEQ ID NO: 151630 - RNA, 1401 nt, Artificial Sequence; identical to SEQ ID NO: 151138
  derived and/or modified sequence opt3 from neuraminidase__InfluenzaB__AGX21703

SEQ ID NO: 151631 - RNA, 1401 nt, Artificial Sequence
  derived and/or modified sequence opt3 from neuraminidase__InfluenzaB__AGX21714
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggacucacccugcugcuccccgaaccugaguggacauauccaagguuaagcugucccgguaguaccuuccagaaggcacugcuuaucuccccucaccgguuuggcgaaacuaaaggaaauucugccccauugauuauccgcgagcccuucauugcuugcgggccuaacgaauguaagcauuuugcacugacacacuacgccgcucagccaggcgguuauuacaaugggacccgaggagaccguaacaaacuaagacaucucaucagcguaaagcugggcaagauaccgacgguggaaaauuccaucuuccacauggccgcguggucaggcagugcaugccaugaugggaaagaguggacuuauauuggagucgacggucccgauaacaaugcccuucugaaggugaaauacggcgaggcuuacaccgacacauaucacagcuacgccaacaagaucuugaggacucaggagucugcauguaauugcauugggggaaacuguuaucucaugaucaccgauggcuccgcuucagguguuagcgaaugccgguuucugaaaauacgcgaggggagaauuaucaaggagauuuucccuacaggaagggugaagcacaccgaagaguguacgugcggcuuugccaguaauaaaacuaucgaaugugcgugccgggacaacucuuacacagccaagcgcccauucgucaaauuaaauguggagaccgauacugcagaaauccgacugaugugcacagacaccuaucucgauacgcccagaccuaacgacggcuccauuaccgggccaugugagagcgauggagacaaggguucgggcgggauaaaaggaggcuuuguacaucaaaggauggagucuaagaucggucggugguacucccguacaaugucaaaaacugaacgcauggggaugggccuuuauguuaaguacgacggagaucccugggcugacagugaugcccuggcuuucagcggcgugauggucuccaugaaggagccggggugguacucuuuuggauucgaaauuaaagacaagaaaugcgaugugccuuguaucgguauagagauggugcacgacggcgggaaggaaaccuggcauagcgccgcaacagccauuuauugcuugaugggaucaggccagcuacugugggauacugucaccgguguugacauggcucucuga

SEQ ID NO: 151632 - RNA, 1401 nt, Artificial Sequence
  derived and/or modified sequence opt3 from neuraminidase__InfluenzaB__AGX21725
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaacgggcccucuuaaucuccccucaucgcuucggcgaaacuaagggaaauucugcaccacugauuauccgagagcccuuuauugccugcgggccuaacgaauguaaacacuucgcucuuacacauuacgcagcccagccaggcgguuauuacaaugggacccguggagacagaaacaaguugaggcaccugaucagcgugaaacuaggcaagauaccgacggucgaaaauuccaucuuucauauggcugccuggucaggcagugcgugccacgaugggaaggaguggacuuauauuggaguggacggucccgauaacaaugcacuccugaaaaucaaguacggcgaggccuacaccgacacauaucacagcuacgcuaacaauauucuucggacucaggagucugccuguaacugcaucgggggaaauuguuaucugaugauaaccgauggcuccgcaucagguguuagcgaaugccgcuucuugaaaauuagagaggggaggaucauuaaggagaucuuuccuacaggacgggugaaacauaccgaagaguguacgugcggcuucgcuaguaacaagacuaucgaaugugccugccgcgacaauucuuacacagcgaagcgaccauuugucaaacucaacguggagaccgauacugccgaaauuagacugaugugcacagacaccuauuuagauacgcccaggccugacgauggcuccauaaccgggccaugugagagcaacggagacaaggguucgggcgggaucaaaggaggcuucguacaccagcggauggcaucuaagauuggucguugguacucccgcacaaugucaaaaacugagagaaaggggaugggccuguauguuaaauacgacggagaucccuggaccgacagugaugcucucgccuuuaggggcgugauggucagcaugaaggaaccggggugguacuccuucggauucgagaucaaggacaaaaagugcgaugugccuuguauagguauugaaauggugcaugacggcgggaaagagacauggcacucugcugccacugcaaucuauugccuuaugggaagcggccaacuguugugggauaccgucacagguguugacauggcccuauga

SEQ ID NO: 151633 - RNA, 1401 nt, Artificial Sequence
  derived and/or modified sequence opt3 from neuraminidase__InfluenzaB__AGX21747
augcugcccagcaccauccagacacucacucuuuuccugacguccggcgggguguuguuaucucuguacgucucagccagucuaagcuaucuccuguacuccgacauucuucugaagguuucucaaaccgagauaacagcuccuacuaugccauuggauugcgcaaacgccucgaaugugcaggcgguaaacagaucagcuaccaaaggagugacacuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaaggaauguaaacauuucgcuuugacccacuacgcagcccagccuggcgguuauuacaacgggacgcgagaggaccguaauaagcugagacaucuaaucagcgucaagcucggaaaaauaccaacuguggagaacuccaucuuucacauggcugccuggucaggcagugcgugccaugauggcagggaauggaccuauauugggguugacggaccggauagcaaugcacugcuuaagaucaaauacggugaggccuacacagacacuuaucacucuuacgcuaagaacauucugcggacccaagaauccgccuguaauugcaucggcggggauuguuauuugaugauaacagacggaucagcaagcggcauuagugagugccgcuuccucaaaaucagagaggguaggauuaucaaggaaaucuuucccaccgggcgggugaagcacacggaggaauguacuugcggauucgcuucuaacaaaacaauugagugugccugccgcgauaauuccuacaccgcgaagcgaccuuuugucaaacugaacguggaaacugacacagccgagauaagauuaaugugcaccgagacguaucuggauaccccaaggcccgacgauggcagcaucacaggcccuugugaaucgaauggggacaagggaucugguggcauuaaagggggauucguacaucagcggauggcauccaagaucggccguugguacucacgcacuaugaguaaaaccaagagaauggguauggggcucuauguuaaguacgacggcgauccauggacagacagcgaggcucuugcccuguccggagugauggucucuauggaggaacccggcugguacagcuuuggguucgaaauaaaagauaagaaaugcgacgugccguguauuggaaucgagauggugcacgaugguggcaagacuaccuggcauucagcugccacagcaaucuauugcuugauggggaguggacagcuacugugggacaccgucacuggcguugauauggcccucuga

SEQ ID NO: 151634 - RNA, 1401 nt, Artificial Sequence
  derived and/or modified sequence opt3 from neuraminidase__InfluenzaB__AGX21758
augcugcccagcaccauccagacacucacucuuuuccugacguccggcgggguguuguuaucucuguacgucucagccagucuaagcuaucuccuguacuccgacauucuucugaaguuuaccccuacagagauaacuguuccaaccaugccguuggauugcgcuaacgcaucuaaugugcaagccguaaacagaucggcgacaaaaggagugacccuccugcugcccgaaccugaguggacuuauccaaggcucucaugucccgguagcacauuccagaaggcuuuacugaucaguccucaccgguuuggcgaaaccaaaggaaauuccgccccacuuauuauccgcgagcccuucauugcaugcgggccuaaggaauguaaacauuuugccuugacgcacuacgcugcacagccaggcgguuauuacaacgggacucgagaggaccguaauaagcugagacaucuaaucucugucaagcucggaaaaauaccgaccguggagaacagcaucuuccacauggccgcuugguccggcucagccugccaugauggcaaggaauggacauauauugggguugacggacccgauaguaaugcgcugcuuaaaaucaaguacggugaggcauacacugacaccuaucacagcuacgccaacaauauucugaggacacaggaaucugcuuguaacugcaucggcgggaauuguuauuugaugauaaccgauggauccgccucaggcauuagcgagugccgguuucucaaaauccgcgaggguagaauuaucaaggaaaucuucccuacggggagggugaagcacacugaggaauguacaugcggauuugcaaguaacaaaaccauugagugugcuugccgggacaauucuuacacugccaagcgcccauucgucaaacugaacguggaaacagauaccgcggagauacgauuaaugugcacggagaccuaucuggacacacccagaccugaugacggcuccaucacuggcccaugugaaagcaaugggaacaagggaucggguggcauuaaagggggauuuguacaucaaaggauggccucuaagaucggccggugguacucccguaccaugucaaaaacaaagcgcauggguauggggcucuauguuaaguacgauggcgaccccuggacugacagugaugcacuugcucugagcggagugauggucuccauggaggaaccgggcugguacucuuucggguuugagauaaaagacaagaaaugcgaugugccuuguauuggaaucgaaauggugcacgacgguggcaaggagaccuggcauagcgccgcuacagccaucuauugcuugauggggucaggacagcuacugugggauaccgucacuggcguugacauggcacucuga

SEQ ID NO: 151635 - RNA, 1401 nt, Artificial Sequence
  derived and/or modified sequence opt3 from neuraminidase__InfluenzaB__AGX21769
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggcuaacagaucagccaccaaaggagugacacuccugcugccggaacccgaguggaccuauccuaggcucagcuguccagguaguacuuuccagaaggcauuacugaucucuccccaccgguuuggcgaaacaaaaggaaauuccgccccucuuauuauccgcgagccauucauugcuugcgggcccaaggaauguaaacauuuugcauugacccacuacgccgcucagccuggcgguuauuacaacgggacgcgagaggaccguaauaagcugagacaucuaaucagcguaaagcucggaaaaauaccaacuguggagaacuccaucuuccacauggccgcguggucaggcagugcaugccaugauggcagggaauggaccuauauuggggucgacggaccggauagcaaugcccugcuuaagaucaaauacggugaggcuuacacagacacuuaucacucuuacgccaagaacauucugcggacccaagaauccgcauguaauugcaucggcggggauuguuauuugaugauaacagacggaucagcuagcggcauuagugagugccgcuuucucaaaaucagagaggguaggauuaucaaggaaaucuuccccaccgggcgggugaagcacacggaggaauguacuugcggauuugccucuaacaaaacaauugagugugcgugccgcgauaauuccuacaccgccaagcgaccuuucguuaaacugaacguggaaacugacacagcagagauaagauuaaugugcaccaagacguaucuggauaccccaaggcccaaugacggcagcaucacaggcccuugugagucggauggggacaaaggaucugguggcauuaaagggggauuuguccaucagcggauggcuuccaagaucggccguugguacucacgcacuaugaguaagaccaagagaauggguauggggcucuaugugaaauacgacggcgauccauggacagacagcgaagcccuugcucuguccggaguaaugguuucuauggaggaacccggcugguacagcuucggguuugagauaaaggauaaaaagugcgacgugccguguauuggaaucgaaaugguccacgaugguggcaaaacuaccuggcauucagccgcaacagccaucuauugcuugauggggaguggacagcuacugugggacaccgugacuggcguggauauggcucucuga

SEQ ID NO: 151636 - RNA, 1401 nt, Artificial Sequence
  derived and/or modified sequence opt3 from neuraminidase__InfluenzaB__AGX21780
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacccgaguggaccuauccuaggcucagcuguccagguaguacuuuccagaaggccuuacugaucucuccccaccgguuuggcgaaacaaaaggaaauuccgcaccucuuauuauccgcgagccauucauugccugcgggcccaaggaauguaaacauuuugcuuugacccacuacgcagcccagccuggcgguuauuacaacgggacgcgagaggaccguaauaagcugagacaucuaaucagcgugaagcucggaaaaauaccaacugucgagaacuccaucuuccacauggcugccuggucaggcagugcgugccaugauggcagggaauggaccuauauugggguggacggaccggauagcaaugcacugcuuaagaucaaauacggugaggccuacacagacacuuaucacucuuacgcuaagaacauucugcggacccaagaauccgccuguaauugcaucggcggggauuguuauuugaugauaacagacggaucagcaagcggcauuagugagugccgcuuucucaaaaucagagaggguaggauuaucaaggaaaucuuccccaccgggcggguuaagcacacggaggaauguacuugcggauuugcuucuaacaaaacaauugagugugccugccgcgauaauuccuacaccgcgaagcgaccuuucgugaaacugaacgucgaaacugacacagccgagauaagauuaaugugcaccgagacguaucuggauaccccaaggcccaaugacggcagcaucacaggcccuugugaaucgaacggggauaagggaucugguggcauuaaagggggauuugugcaucagcggauggaguccaagaucggccguugguacucacgcacuaugaguaaaaccaagagaauggguauggggcucuauguaaaguacgacggcgacccauggacagauagcgaagcacuugcucuguccggaguuauggugucuauggaggaacccggcugguacagcuucggguuugagauaaaagacaagaaaugcgaugucccguguauuggaaucgagauggugcacgacgguggcaagacuaccuggcauucagccgcuacagccaucuauugcuugauggggaguggacagcuacugugggauaccgugacuggcgucgacaugacgcucuga

SEQ ID NO: 151637 - RNA, 1401 nt, Artificial Sequence
  derived and/or modified sequence opt3 from neuraminidase__InfluenzaB__AGX21791
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacagcgggacgcgaggagaccguaacaagcugagacaucuaaucuccgugaagcucggcaaaauaccgacugucgaaaauucaaucuuccacauggcugccuggaguggcagcgcgugccaugaugggaaggaguggaccuauauuggaguggacggucccgauaacaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauaacuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugaguaaaaacaagcgcauggggaugggccucuauguaaaguacgacggagaccccugggcugauucagacgcccuugcucugagcggcguuaugguguccauggaggagccggggugguacucuuucggauuugaaauaaaagauaagaaaugcgacgucccuuguauugguaucgagauggugcacgauggcgggaaggaaaccuggcauagcgccgcaacagccaucuauugcuugaugggaucaggccagcuacugugggacacugugaccggugucgauauggcucucuga

SEQ ID NO: 151638 - RNA, 1401 nt, Artificial Sequence
  derived and/or modified sequence opt3 from neuraminidase__InfluenzaB__AGX21802
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggcuaacagaucagccaccaaaggagugacacuccugcugccggaacccgaguggaccuauccuaggcucagcuguccagguaguacuuuccagaaggcauuacugaucucuccccaccgguuuggcgaaacaaaaggaaauuccgccccucuuauuauccgcgagccauucauugcuugcgggcccaaggaauguaaacauuuugcauugacccacuacgccgcucagccuggcgguuauuacaacgggacgcgagaggaccguaauaagcugagacaucuaaucagcguaaagcucggaaaaauaccaacuguggagaacuccaucuuccacauggccgcguggucaggcagugcaugccaugauggcagggaauggaccuauauuggggucgacggaccggauagcaaugcccugcuuaagaucaaauacggugaggcuuacacagacacuuaucacucuuacgccaagaacauucugcggacccaagaauccgcauguaauugcaucggcggggauuguuauuugaugauaacagacggaucagcuagcggcauuagugagugccgcuuucucaaaaucagagaggguaggauuaucaaggaaaucuuccccaccgggcgggugaagcacacggaggaauguacuugcggauuugccucuaacaaaacaauugagugugcgugccgcgauaauuccuacaccgccaagcgaccuuucguuaaacugaacguggaaacugacacagcagagauaagauuaaugugcaccgagacguaucuggauaccccaaggcccaaugacggcagcaucacaggcccuugugaaucggauggggacaagggaucugguggcauuaaagggggauuuguccaucagcggauggcuuccaagaucggccguugguacucacgcacuaugaguaaaaccaagagaauggguauggggcucuaugugaaguacgacggcgauccauggacagacagcgaggcccuugcucuguccggaguaaugguuucuauggaggaacccggcugguacagcuucggguuugaaauaaaagauaagaaaugcgacgugccguguauuggaaucgagaugguccacgaugguggcaagacuaccuggcauucagccgcaacagccaucuauugcuugauggggaguggacagcuacugugggacaccgugacuggcguggauauggcucucuga

SEQ ID NO: 151639 - RNA, 1401 nt, Artificial Sequence
  derived and/or modified sequence opt3 from neuraminidase__InfluenzaB__AGX21813
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaaaaugccauuggauugcgcaaacgccucgaauguucaggcggcuaacagaucagccacuaagggagugacccuccugcugccggaacccgaguggacauauccuaggcucagcuguccagguaguaccuuccagaaagcauuacugaucucuccccaccgguuuggcgaaacuaagggaaauuccgccccucuuauuauccgcgagccauucauugcuugcgggcccaaagaauguaagcauuuugcauugacacacuacgccgcucagccuggcgguuauuacaacgggacccgagaggaccguaauaagcugagacaucuaaucagcguaaaacucggaaagauaccaacgguggagaacuccaucuuccacauggccgcguggucaggcagugcaugccaugauggcagggaauggacuuauauuggggucgacggaccggauagcaaugcccugcuuaaaaucaaguacggugaggcuuacaccgacacauaucacucuuacgccaaaaacauucugcggacucaagaauccgcauguaauugcaucggcggggauuguuauuugaugauaaccgacggaucagcuagcggcauuagugagugccgcuuucucaagaucagagaggguaggauuaucaaggaaaucuuccccacagggcgggugaaacacaccgaggaauguacgugcggauuugccucuaacaagacuauugagugugcgugccgcgauaauuccuacacagccaaacgaccuuucguuaagcugaacguggaaaccgacacugcagagauaagauuaaugugcacagagaccuaucuggauacgccaaggcccaaugacggcagcaucaccggcccuugugaaucggauggggacaaaggaucugguggcauuaaagggggauuuguccaucagcggauggcuuccaagaucggccguugguacucacgcacaaugaguaagacuaagagaauggguauggggcucuaugugaaauacgacggcgauccauggaccgacagcgaggcccuugcucuguccggaguaaugguuucuauggaggaacccggcugguacagcuucggguuugaaauaaaggauaaaaagugcgacgugccguguauuggaaucgagaugguccacgaugguggcaaaacaacuuggcauucagccgcaaccgccaucuauugcuugauggggaguggacagcuacugugggacacagugaccggcguggauauggcucucuga

SEQ ID NO: 151640 - RNA, 1401 nt, Artificial Sequence
  derived and/or modified sequence opt3 from neuraminidase__InfluenzaB__AGX21824
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcagggaauggacuuauaucgggguggacggaccggauagcaaugcacugcuuaagauuaaauacggugaggccuacaccgacacauaucacucuuacgcuaagaacauccugcggacucaagaauccgccuguaauugcauaggcggggauuguuauuugaugauuaccgacggacccgcaucaggcaucagcgagugccgcuuucucaaaauuagagaggguaggaucaucaaggaaauuuucccuacagggcggguuaagaacaccgaggaauguacgugcggauuugcuaguaauaaaacuauagagugugccugccgcgauaacucuuacacagcgaagcgaccauucgugaaacugaaugucgaaaccgacacugccgagaucagauuaaugugcacagagaccuaucuggauacgcccaggccuaacgacggcuccauuaccggcccaugugaaagcaauggggauaagggaucggguggcaucaaagggggauuugugcaccagcggauggcaucuaagauaggccguugguacucccgcacaaugucaaaaacuaagagaauggguauggggcucuauguaaaguacgacggcgaccccuggaccgauagugaggcucuugcccugagcggaguuaugguguccauggaggaaccgggcugguacucuuucggguuugaaauuaaagacaagaaaugcgaugucccuuguaucggaaucgagauggugcaugacgguggcaagacaacuuggcacagcgcugccaccgcaauuuauugcuugauggggucaggacagcuacugugggauacagugaccggcgucgacauggcccucuga

SEQ ID NO: 151641 - RNA, 1401 nt, Artificial Sequence; identical to SEQ ID NO: 150759
  derived and/or modified sequence opt3 from neuraminidase__InfluenzaB__AGX21835

SEQ ID NO: 151642 - RNA, 1401 nt, Artificial Sequence; identical to SEQ ID NO: 151147
  derived and/or modified sequence opt3 from neuraminidase__InfluenzaB__AGX21846

SEQ ID NO: 151643 - RNA, 1401 nt, Artificial Sequence; identical to SEQ ID NO: 151147
  derived and/or modified sequence opt3 from neuraminidase__InfluenzaB__AGX21857

SEQ ID NO: 151644 - RNA, 1401 nt, Artificial Sequence; identical to SEQ ID NO: 150759
  derived and/or modified sequence opt3 from neuraminidase__InfluenzaB__AGX21868

SEQ ID NO: 151645 - RNA, 1401 nt, Artificial Sequence; identical to SEQ ID NO: 151145
  derived and/or modified sequence opt3 from neuraminidase__InfluenzaB__AGX21879

SEQ ID NO: 151646 - RNA, 1401 nt, Artificial Sequence
  derived and/or modified sequence opt3 from neuraminidase__InfluenzaB__AGX21890
augcugcccagcaccauccagacacucacucuuuuccugacguccggcgggguguuguuaucucuguacgucucagccagucuaagcuaucuccuguacuccgacauucuucugaaguuuucucaaaccgagauaaucgcuccuauuaugccauuggauugcgcaaacgccucgaauguucaggcggugaaccacucagcuacaaaaggaguaacucuccugcugccggaacccgaguggaccuauccuagacucagcuguccagguaguacauuccagaaggccuuacugaucucuccccauagguuuggcgaaaccaaaggaaauuccgcaccucuuauuauccgggagccauucauagccugcgggcccaaggaauguaaacacuuugcuuugacucauuacgcagcccagccuggcgguuauuacaacgggacacgcgaggaccgaaauaagcugcgucaccuaaucagcgugaagcucggaaaaauuccaaccgucgagaacuccaucuuccauauggcugccuggucaggcagugcgugccacgauggcagagaauggacguauauugggguggacggaccggauagcaaugcacugcuuaagaucaaauacggugaggccuacacugacaccuaucacucuuacgcuaagaacauacugaggacacaagaauccgccuguaauugcauuggcggggauuguuauuugaugaucacugacggacccgcaucaggcauuagcgagugccgguuucucaaaauccgcgaggguagaaucauuaaggaaauauucccuaccgggaggguuaagcauacagaggaauguaccugcggauuugcuaguaacaaaacgaucgagugugccugccgggauaauucuuacacugcgaagcgcccauucgugaaacugaacgucgaaacagacaccgccgagauucgauuaaugugcacugagacauaucuggauacccccagaccuaaugacggcuccaucacgggcccaugugaaagcaacggggauaagggaucggguggcauaaaagggggauuugugcaccagaggauggcaucuaagauuggccggugguacucccguaccaugucaaaaacaaagcgcauggguauggggcucuauguaaaguacgacggcgaccccuggacugauagugaggcucuugcccugagcggaguuaugguguccauggaggaaccgggcugguacucuuucggguuugaaaucaaagacaagaaaugcgaugucccuuguaucggaauugagauggugcaugacgguggcaagaccacauggcacagcgcugccacugcaaucuauugcuugauggggucaggacagcuacugugggauaccgugacaggcgucgacauggcccucuga

SEQ ID NO: 151647 - RNA, 1401 nt, Artificial Sequence; identical to SEQ ID NO: 150759
  derived and/or modified sequence opt3 from neuraminidase__InfluenzaB__AGX21901

SEQ ID NO: 151648 - RNA, 1401 nt, Artificial Sequence; identical to SEQ ID NO: 150759
  derived and/or modified sequence opt3 from neuraminidase__InfluenzaB__AGX21912

SEQ ID NO: 151649 - RNA, 1401 nt, Artificial Sequence
  derived and/or modified sequence opt3 from neuraminidase__InfluenzaB__AGX21923
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaacagaucagcgaccaaaggaguaacacuccugcugccggaacccgaguggaccuauccuaggcucagcuguccagguaguacuuuccagaaggcuuuacugauuucuccccaccgguuuggcgaaacaaaaggaaauuccgccccucuuaucauucgcgagccauucaucgcaugcgggcccaaggaauguaaacauuuugccuugacccacuacgcugcacagccuggcgguuauuacaacgggacgcgagaggaccguaauaagcugagacaucuaauaagcgugaagcucggaaaaaucccaacugucgagaacuccauuuuccacauggccgcuuggucaggcagugccugccaugauggcagggaauggaccuauaucgggguggacggaccggauagcaaugcgcugcuuaagauuaaauacggugaggcauacacagacacuuaucacucuuacgccaagaacauccugcggacccaagaauccgcuuguaauugcauaggcggggauuguuauuugaugauuacagacggacccgccucaggcaucagcgagugccgcuuucucaaaauuagagaggguaggaucaucaaggaaauuuucccuaccgggcggguuaagcacacggaggaauguacuugcggauuugcaaguaacaaaacaauagagugugcuugccgcgauaauucuuacaccgccaagcgaccauucgugaaacugaacgucgaaacugacacagcggagaucagauuaaugugcaccgagacguaucuggauacccccaggccuaaugacggcuccauuacaggcccaugugaaagcaacggggauaagggaucggguggcaucaaagggggauuugugcaucagcggauggccucuaagauaggccguugguacucccgcacuaugucaaaaaccaagagaauggguauggggcucuauguaaaguacgacggcgaccccuggacagauagugaggcacuugcucugagcggaguuaugguguccauggaggaaccgggcugguacucuuucggguuugaaauuaaagacaagaaaugcgaugucccuuguaucggaaucgagauggugcacgacgguggcaagacuaccuggcauagcgccgcuacagccauuuauugcuugauggggucaggacagcuacugugggauaccgugacuggcgucgacauggcacucuga

SEQ ID NO: 151650 - RNA, 1401 nt, Artificial Sequence; identical to SEQ ID NO: 151646
  derived and/or modified sequence opt3 from neuraminidase__InfluenzaB__AGX21934

SEQ ID NO: 151651 - RNA, 1401 nt, Artificial Sequence; identical to SEQ ID NO: 151147
  derived and/or modified sequence opt3 from neuraminidase__InfluenzaB__AGX21945

SEQ ID NO: 151652 - RNA, 1401 nt, Artificial Sequence
  derived and/or modified sequence opt3 from neuraminidase__InfluenzaB__AGX21956
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacacuucgaauauucaggccguuaacagaucagcgaccaaaggagugacacuccugcugccggaacccgaguggaccuauccuaggcucagcuguccagguaguacuuuccagaaggcuuuacugaucucuccccaccgguuuggcgaaacaaaaggaaauuccgccccucuuauuauccgcgagccauucauagcaugcgggcccaaggaauguaaacauuuugccuugacccacuacgcugcacagccuggcgguuauuacaacgggacgcgagaggaccguaauaagcugagacaucuaaucagcguaaagcucggaaaaauuccaacuguggagaacuccaucuuccacauggccgcuuggucaggcagugccugccaugauggcagggaauggaccuauauuggggucgacggaccggauagcaaugcgcugcuuaagaucaaauacggugaggcauacacagacacuuaucacucuuacgccaagaacauacugcggacccaagaauccgcuuguaauugcauuggcggggauuguuauuugaugaucacagacggacccgccucaggcauuagcgagugccgcuuucucaaaaucagagaggguaggaucauuaaggaaauauucccuaccgggcgggugaagcacacggaggaauguacuugcggauuugcaaguaacaaaacaaucgagugugcuugccgcgauaauucuuacaccgccaagcgaccauucguuaaacugaacguggaaacugacacagcggagauuagauuaaugugcaccgagacguaucuggauacccccaggccuaaugacggcuccaucacaggcccaugugaaagcaacggggauaagggaucggguggcauaaaagggggauuuguccaucagcggauggccucuaagauuggccguugguacucccgcacuaugucaaaaaccaagagaauggguauggggcucuaugugaaguacgacggcgaccccuggacagauagugaggcacuugcucugagcggaguaaugguuuccauggaggaaccgggcugguacucuuucggguuugaaaucaaagacaagaaaugcgaugugccuuguaucggaauugagaugguccacgacgguggcaagacuaccuggcauagcgccgcuacagccaucuauugcuugauggggucaggacagcuacugugggauaccgugacuggcguggacauggcacucuga

SEQ ID NO: 151653 - RNA, 1401 nt, Artificial Sequence; identical to SEQ ID NO: 151147
  derived and/or modified sequence opt3 from neuraminidase__InfluenzaB__AGX21967

SEQ ID NO: 151654 - RNA, 1401 nt, Artificial Sequence; identical to SEQ ID NO: 150759
  derived and/or modified sequence opt3 from neuraminidase__InfluenzaB__AGX21978

SEQ ID NO: 151655 - RNA, 1401 nt, Artificial Sequence; identical to SEQ ID NO: 151147
  derived and/or modified sequence opt3 from neuraminidase__InfluenzaB__AGX21989

SEQ ID NO: 151656 - RNA, 1401 nt, Artificial Sequence; identical to SEQ ID NO: 151145
  derived and/or modified sequence opt3 from neuraminidase__InfluenzaB__AGX22000

SEQ ID NO: 151657 - RNA, 1401 nt, Artificial Sequence
  derived and/or modified sequence opt3 from neuraminidase__InfluenzaB__AGX22011
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagccaagccuggcgguuauuacaacgggacccgagaggaccguaauaagcugagacaucuaauaagcgugaaacucggaaagaucccaacggucgagaacuccauuuuccacauggcugccuggucaggcagugcgugccaugauggcagggaauggacuuauaucgggguggacggaccggauagcaaugcacugcuuaaaauuaaguacggugaggccuacaccgacacauaucacucuuacgcuaaaaacauccugcggacucaggaauccgccuguaauugcauaggcggggauuguuauuugaugauuaccgacggacccgcaucaggcaucagcgagugccgcuuucucaagauuagagaggguaggaucaucaaggaaauuuucccuacagggcggguuaaacacaccgaggaauguacgugcggauuugcuaguaacaagacuauagagugugccugccgcgauaauaacuacacagcgaaacgaccauucgugaagcugaaugucgaaaccgacacugccgagaucagauuaaugugcacagagaccuaucuggauacgcccaggccuaacgacggcucuauuaccggcccaugugaauccaauggggauaaaggaagcgguggcaucaaagggggauuugugcaucaacggauggcaucgaagauaggccguugguacucucgcacaauguccaagacuaagagaauggguauggggcucuauguaaaauacgacggcgaccccuggaccgauucagaggcucuugcccugaguggaguuauggugagcauggaggaaccgggcugguacuccuucggguuugaaauuaaggacaaaaagugcgaugucccuuguaucggaaucgagauggugcacgacgguggcaaaacaacuuggcauucugcugccaccgcaauuuauugcuugauggggagcggacagcuacugugggauacagugaccggcgucgacauggcccucuga

SEQ ID NO: 151658 - RNA, 1401 nt, Artificial Sequence; identical to SEQ ID NO: 150759
  derived and/or modified sequence opt3 from neuraminidase__InfluenzaB__AGX22033

SEQ ID NO: 151659 - RNA, 1401 nt, Artificial Sequence; identical to SEQ ID NO: 150759
  derived and/or modified sequence opt3 from neuraminidase__InfluenzaB__AGX22044

SEQ ID NO: 151660 - RNA, 1401 nt, Artificial Sequence; identical to SEQ ID NO: 151145
  derived and/or modified sequence opt3 from neuraminidase__InfluenzaB__AGX22055

SEQ ID NO: 151661 - RNA, 1401 nt, Artificial Sequence; identical to SEQ ID NO: 150759
  derived and/or modified sequence opt3 from neuraminidase__InfluenzaB__AGX22066

SEQ ID NO: 151662 - RNA, 1401 nt, Artificial Sequence; identical to SEQ ID NO: 151646
  derived and/or modified sequence opt3 from neuraminidase__InfluenzaB__AGX22077

SEQ ID NO: 151663 - RNA, 1401 nt, Artificial Sequence; identical to SEQ ID NO: 150761
  derived and/or modified sequence opt3 from neuraminidase__InfluenzaB__AGX22088

SEQ ID NO: 151664 - RNA, 1401 nt, Artificial Sequence; identical to SEQ ID NO: 151147
  derived and/or modified sequence opt3 from neuraminidase__InfluenzaB__AGX22099

SEQ ID NO: 151665 - RNA, 1401 nt, Artificial Sequence; identical to SEQ ID NO: 151145
  derived and/or modified sequence opt3 from neuraminidase__InfluenzaB__AGX22110

SEQ ID NO: 151666 - RNA, 1401 nt, Artificial Sequence; identical to SEQ ID NO: 151147
  derived and/or modified sequence opt3 from neuraminidase__InfluenzaB__AGX22132

SEQ ID NO: 151667 - RNA, 1401 nt, Artificial Sequence
  derived and/or modified sequence opt3 from neuraminidase__InfluenzaB__AGX22143
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcagggaauggacuuauaucgggguggacggaccggauagcaaugcacugcuuaagauuaaauacggugaggccuacaccgacacauaucacucuuacgcuaagaacauccugcggacucaagaauccgccuguaauugcauaggcggggauuguuauuugaugauuaccgacggacccgcaucaggcaucagcgagugccgcuuucucaaaauuagagaggguaggaucaucaaggaaauuuucccuacagggcggguuaagcacaccgaggaauguacgugcggauuugcuaguaacaaaacuauagagugugccugccgcgauaauucuuacacagcgaagcgaccauucgugaaacugaacgucgaaaccgacacugccgagaucagauuaaugugcacagagaccuaucuggauacgcccaggccuaaugacggcuccauuaccggcccaugugaaagcaacggggauaagggaucggguggcaucaaagggggauuugugcaucagcggauggcaucuaagauaggccguugguacucccgcacaauuucaaaaacuaagagaauggguauggggcucuauguaaaguacgacggcgaccccuggaccgauagugaggcucuugcccugagcggaguuaugguguccauggaggaaccgggcugguacucuuucggguuugaaaucaaagacaagaaaugcgaugucccuuguaucggaauugagauggugcacgacgguggcaagacaacuuggcauagcgcugccaccgcaaucuauugcuugauggggucaggacagcuacugugggauacagugaccggcgucgacauggcccucuga

SEQ ID NO: 151668 - RNA, 1401 nt, Artificial Sequence; identical to SEQ ID NO: 151667
  derived and/or modified sequence opt3 from neuraminidase__InfluenzaB__AGX22154

SEQ ID NO: 151669 - RNA, 1401 nt, Artificial Sequence; identical to SEQ ID NO: 151667
  derived and/or modified sequence opt3 from neuraminidase__InfluenzaB__AGX22165

SEQ ID NO: 151670 - RNA, 1401 nt, Artificial Sequence; identical to SEQ ID NO: 151646
  derived and/or modified sequence opt3 from neuraminidase__InfluenzaB__AGX22176

SEQ ID NO: 151671 - RNA, 1401 nt, Artificial Sequence; identical to SEQ ID NO: 151667
  derived and/or modified sequence opt3 from neuraminidase__InfluenzaB__AGX22187

SEQ ID NO: 151672 - RNA, 1401 nt, Artificial Sequence; identical to SEQ ID NO: 151667
  derived and/or modified sequence opt3 from neuraminidase__InfluenzaB__AGX22198

SEQ ID NO: 151673 - RNA, 1401 nt, Artificial Sequence; identical to SEQ ID NO: 151667
  derived and/or modified sequence opt3 from neuraminidase__InfluenzaB__AGX22209

SEQ ID NO: 151674 - RNA, 1401 nt, Artificial Sequence; identical to SEQ ID NO: 151145
  derived and/or modified sequence opt3 from neuraminidase__InfluenzaB__AGX22220

SEQ ID NO: 151675 - RNA, 1401 nt, Artificial Sequence; identical to SEQ ID NO: 151147
  derived and/or modified sequence opt3 from neuraminidase__InfluenzaB__AGX22231

SEQ ID NO: 151676 - RNA, 1401 nt, Artificial Sequence; identical to SEQ ID NO: 151646
  derived and/or modified sequence opt3 from neuraminidase__InfluenzaB__AGX22242

SEQ ID NO: 151677 - RNA, 1401 nt, Artificial Sequence; identical to SEQ ID NO: 151145
  derived and/or modified sequence opt3 from neuraminidase__InfluenzaB__AGX22253

SEQ ID NO: 151678 - RNA, 1401 nt, Artificial Sequence; identical to SEQ ID NO: 150759
  derived and/or modified sequence opt3 from neuraminidase__InfluenzaB__AGX22264

SEQ ID NO: 151679 - RNA, 1401 nt, Artificial Sequence; identical to SEQ ID NO: 151145
  derived and/or modified sequence opt3 from neuraminidase__InfluenzaB__AGX22275

SEQ ID NO: 151680 - RNA, 1401 nt, Artificial Sequence; identical to SEQ ID NO: 150759
  derived and/or modified sequence opt3 from neuraminidase__InfluenzaB__AGX22286

SEQ ID NO: 151681 - RNA, 1401 nt, Artificial Sequence
  derived and/or modified sequence opt3 from neuraminidase__InfluenzaB__AGX22297
augcugcccagcaccauccagacacucacucuuuuccugacguugggcgggguguuacugucccuauacgucucugccucacucaguuaucugcuuuacagcgacauucuguugaaguuuucccaaaccgagauaacagcuccuaucaugccacucgauugcgcaaacgccucuaauguucaggcggugaacagaucggcuacuaaaggaguaacccugcugcucccggaacccgaguggacauauccuagguuaucauguccagguagcaccuuccagaaggcccugcuuauuaguccccaccgguuuggcgaaacuaaaggaaauuccgcaccuuugaucauucgcgagccauucaucgccugcgggcccaaggaauguaaacauuuugcucugacacacuacgcagcccagccuggcgguuauuacaacgggacccgagaggaccguaauaagcuaagacaucucauaucugugaagcugggaaaaaucccaacggucgagaacagcauuuuccacauggcugccugguccggcucagcgugccaugauggcagggaauggacuuauaucgggguggacggaccggauaguaaugcacuucugaagauuaaauacggugaggccuacaccgacacauaucacagcuacgcuaagaacaucuugcggacucaagaaucugccuguaauugcauaggcggggauuguuaucucaugauuaccgacggacccgcauccggcaucucagagugccgcuuucugaaaauuagagaggguaggaucaucaaggaaauuuucccuacagggcggguuaagcacaccgaggaauguacgugcggauuugcuagcaacaaaacuauagagugugccugccgcgauaauaguuacacagcgaagcgaccauucgugaaauuaaacgucgaaaccgacacugccgagaucagacugaugugcacagagaccuaucucgauacgcccaggccuaaugacggcucuauuaccggcccaugugaauccaacggggauaagggaagcgguggcaucaaagggggauuugugcaucagcggauggcaucgaagauaggccguugguacucucgcacaauguccaaaacuaagagaauggguauggggcuuuauguaaaguacgacggcgaccccuggaccgauucagaggcucuggccuugaguggaguuauggugagcauggaggaaccgggcugguacuccuucggguuugaaauuaaagacaagaaaugcgaugucccuuguaucggaaucgagauggugcacgacgguggcaagacaacuuggcauucugcugccaccgcaauuuauugccuaauggggagcggacagcugcucugggauacagugaccggcgucgacauggcccuguga

SEQ ID NO: 151682 - RNA, 1401 nt, Artificial Sequence; identical to SEQ ID NO: 150759
  derived and/or modified sequence opt3 from neuraminidase__InfluenzaB__AGX22308

SEQ ID NO: 151683 - RNA, 1401 nt, Artificial Sequence
  derived and/or modified sequence opt3 from neuraminidase__InfluenzaB__AGX22330
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacaugacugcuuggucaggcagugccugccaugauggcaaggaauggaccuauaucgggguggacggaccggauagcaaugcgcugcuuaaaauuaaguacggugaggcauacacagacacuuaucacucuuacgccaaaaacauccugaggacccaagaauccgcuuguaauugcauaggcggggauuguuauuugaugauuacagacggacccgccucaggcaucagcgagugccgguuucucaagauucgcgaggguagaaucaucaaggaaauuuucccuaccgggaggguuaaacacacggaggaauguacuugcggauuugcaaguaacaagacaauagagugugcuugccgggauaauucuuacaccgccaaacgcccauucgugaagcugaacgucgaaacugacacagcggagauccgauuaaugugcaccgagacguaucuggauacccccagaccuaaugacggcuccauuacaggcccaugugaaagcgauggggacaaaggaucggguggcaucaaagggggauuugugcaucagaggauggccacuaagauaggccggugguacucucguaccauguccaagacaaagcgcauggguauggggcucuauguaaaauacgacggcgaucccuggacugacucagaggcacuugcucugaguggaguuauggugagcauggaggaaccgggcugguacuccuucggguuugaaauuaaggauaaaaagugcgacgucccuuguaucggaaucgagauggugcacgaugguggcaaaaccacauggcauucugccgcuaccgccauuuauugcuugauggggagcggacagcuacugugggacacugugacgggcgucgauauggcacucuga

SEQ ID NO: 151684 - RNA, 1401 nt, Artificial Sequence; identical to SEQ ID NO: 151147
  derived and/or modified sequence opt3 from neuraminidase__InfluenzaB__AGX22341

SEQ ID NO: 151685 - RNA, 1401 nt, Artificial Sequence; identical to SEQ ID NO: 151147
  derived and/or modified sequence opt3 from neuraminidase__InfluenzaB__AGX22352

SEQ ID NO: 151686 - RNA, 1401 nt, Artificial Sequence; identical to SEQ ID NO: 151147
  derived and/or modified sequence opt3 from neuraminidase__InfluenzaB__AGX22363

SEQ ID NO: 151687 - RNA, 1401 nt, Artificial Sequence; identical to SEQ ID NO: 151145
  derived and/or modified sequence opt3 from neuraminidase__InfluenzaB__AGX22374

SEQ ID NO: 151688 - RNA, 1401 nt, Artificial Sequence; identical to SEQ ID NO: 150759
  derived and/or modified sequence opt3 from neuraminidase__InfluenzaB__AGX22385

SEQ ID NO: 151689 - RNA, 1401 nt, Artificial Sequence; identical to SEQ ID NO: 150759
  derived and/or modified sequence opt3 from neuraminidase__InfluenzaB__AGX22396

SEQ ID NO: 151690 - RNA, 1401 nt, Artificial Sequence; identical to SEQ ID NO: 151646
  derived and/or modified sequence opt3 from neuraminidase__InfluenzaB__AGX22407

SEQ ID NO: 151691 - RNA, 1401 nt, Artificial Sequence
  derived and/or modified sequence opt3 from neuraminidase__InfluenzaB__AGX22418
augcugcccagcaccauccagacacucacucuuuuccugacguccggcgggguguuguuaucucuguacgucucagccagucuaagcuaucuccuguacuccgacauucuucugaaguuuucucaaaccgagauaaucgcuccuauuaugccauuggauugcgcaaacgccucgaauguucaggcggugaaccacucagcuacaaaaggaguaacucuccugcugccggaacccgaguggaccuauccuagacucagcuguccagguaguacauuccagaaggccuuacugaucucuccccauagguuuggcgaaaccaaaggaaauuccgcaccucuuauuauccgggagccauucauagccugcgggcccaaggaauguaaacacuuugcuuugacucauuacgcagcccagccuggccgcuauuacaacgguacacgagaggaccguaauaagcugagacaccuaaucagcgugaagcucgggaaaauuccaaccgucgagaacuccaucuuccauauggcugccuggucaggaagugcgugccacgauggcagggaauggacguauauuggcguggacgggccggauagcaaugcacugcuuaagaucaaauacggagaggccuacacugacaccuaucacucuuacgcuaagaacauacugcggacacaagaauccgccuguaauugcauugguggcgauuguuauuugaugaucacugacgggcccgcaucaggaauuagcgagugccgcuuucucaaaaucagagagggcaggaucauuaaggaaauauucccuaccggucggguuaagcauacagaggaauguaccugcggguuugcuaguaacaaaacgaucgagugugccugccgcgauaauucuuacacugcgaagcgaccauucgugaaacugaacgucgaaacagacaccgccgagauuagauuaaugugcacugagacauaucuggauacccccaggccuaaugacggauccaucacgggcccaugugaaagcaacggcgauaaggggucgggagguauaaaaggcggguuugugcaccagcggauggcaucuaagauuggacguugguacucccgcaccaugucaaaaacaaagagaaugggcaugggucucuauguaaaguacgacggggaccccuggacugauagugaggcucuugcccugagcggcguuaugguguccauggaggaaccgggaugguacucuuucggcuuugaaaucaaagacaagaaaugcgaugucccuuguaucgggauugagauggugcaugacggagguaagaccacauggcacagcgcugccacugcaaucuauugcuugaugggcucagggcagcuacugugggauaccgugacaggagucgacauggcccucuga

SEQ ID NO: 151692 - RNA, 1401 nt, Artificial Sequence; identical to SEQ ID NO: 151145
  derived and/or modified sequence opt3 from neuraminidase__InfluenzaB__AGX22429

SEQ ID NO: 151693 - RNA, 1401 nt, Artificial Sequence; identical to SEQ ID NO: 151145
  derived and/or modified sequence opt3 from neuraminidase__InfluenzaB__AGX22440

SEQ ID NO: 151694 - RNA, 1401 nt, Artificial Sequence; identical to SEQ ID NO: 151145
  derived and/or modified sequence opt3 from neuraminidase__InfluenzaB__AGX22449

SEQ ID NO: 151695 - RNA, 1401 nt, Artificial Sequence
  derived and/or modified sequence opt3 from neuraminidase__InfluenzaB__AGX22460
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcuaccaaaggaguaacacuccugcugccggaacucgaguggaccuaucccagguuaagcuguccugguaguacuuuccagaaggcccugcuuaucuccccacaccgguuuggcgaaacaaaaggaaauucugcacccuugauuauccgcgagccuuucauugccugcgggccaaaggaauguaaacauuuugcucugacccacuacgcagcccagcccggcgguuauuacaacgggacgcgagaggaccguaauaagcuaagacaucucaucagcgugaagcugggaaaaauaccuacugucgagaacuccaucuuccacauggcugccuggucaggcagugcgugccaugauggcagggaauggaccuauguggggguugacggaccagauagcaaugcacuucugaagauuaaauacggugaggccuacacagacacuuaucacucuuacgcuaagaacaucuugcggacccaagaauccgccuguaauugcauuggcggggauuguuaucucaugaucacagacggaccggcaucaggcauaagcgagugccgcuuucugaaaauuagagaggguaggaucauuaaggaaaucuuccccaccgggcgggugaagcacacggaggaauguacuugcggauuugcuaguaacaaaacaaucgagugugccugccgcgauaauucuuacaccgcgaagcgaccuuucgucaaauuagacguggaaacugauacagccgagauuagacugaugugcaccgagacguaucucgacaccccaaggcccaacgauggcuccauaacaggcccuugugaagcaaauggggacaagggaagcgguggcaucaaagggggauuuguacaucagcggauggcuucgaagauuggccguugguacucucgcacuauguccaaaaccaagagaauggguauggggcuuuauguuaaguacgacggcgauccauggacagacucagaggcccuggcuuugaguggagugauggucagcauggaggaacccggcugguacuccuucggguuugaaaucaaagauaagaaaugcgacgugccguguauaggaauugagauggugcacgaugguggcaagacuaccuggcauucugccgcaacagccaucuauugccuaauggggagcggacagcugcucugggacaccgucacuggcguugauauggcucuguga

SEQ ID NO: 151696 - RNA, 1401 nt, Artificial Sequence; identical to SEQ ID NO: 150759
  derived and/or modified sequence opt3 from neuraminidase__InfluenzaB__AGX22471

SEQ ID NO: 151697 - RNA, 1401 nt, Artificial Sequence; identical to SEQ ID NO: 150759
  derived and/or modified sequence opt3 from neuraminidase__InfluenzaB__AGX22482

SEQ ID NO: 151698 - RNA, 1401 nt, Artificial Sequence; identical to SEQ ID NO: 150759
  derived and/or modified sequence opt3 from neuraminidase__InfluenzaB__AGX22493

SEQ ID NO: 151699 - RNA, 1401 nt, Artificial Sequence
  derived and/or modified sequence opt3 from neuraminidase__InfluenzaB__AGX22504
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaucccauuggauugcgcaaacgccucgaauguucaagcggugaacagaucagcuacaaaaggaguaacccuccugcugccggaacccgaguggacuuauccuaggcucagcuguccagguaguacauuccagaaggccuuacugauuucuccccaccgguuuggcgaaaccaaaggaaauuccgcaccucuuaucauucgcgagccauucaucgccugcgggcccaaggaauguaaacauuuugcuuugacgcacuacgcagcccagccuggcgguuauuacaacgggacucgagaggaccguaauaagcugagacaucuaauaagcgugaagcucggaaaaaucccaaccgucgagaacuccauuuuccacauggcugccuggucaggcagugcgugccaugauggcaaggaauggacauauaucgggguggacggaccggauagcaaugcacugcuuaaaauuaaguacggugaggccuacacugacaccuaucacucuuacgcuaacaauauccugaggacacaggaauccgccuguaacugcauaggcgggaauuguuauuugaugauuaccgauggaucagcaagcggcaucagugagugccgguuucucaaaauucgcgaggguagaaucaucaaggaaauuuuccccacggggaggguuaagcacacugaggaauguacaugcggauuugcuucuaacaaaaccauagagugugccugccgggacaauuccuacacugcgaagcgcccuuucgugaaacugaacgucgaaacagauaccgccgagauccgauuaaugugcacggagaccuaucuggacacaccaagacccgaugacggcagcauuacuggcccuugugaaucgaaugggaacaagggaucugguggcaucaaagggggauuugugcaucaaaggauggcauccaagauaggccggugguacucacguaccaugaguaaaacaaagcgcauggguauggggcucuauguaaaguacgauggcgacccauggacugacagcgaugcucuugcccuguccggaguuauggugucuauggaggaacccggcugguacagcuucggguuugagauuaaagacaagaaaugcgaugucccguguaucggaaucgaaauggugcacgacgguggcaaggagaccuggcauucagcugccacagcaauuuauugcuugauggggaguggacagcuacugugggauaccgugacuggcgucgacauggcccucuga

SEQ ID NO: 151700 - RNA, 1401 nt, Artificial Sequence; identical to SEQ ID NO: 151145
  derived and/or modified sequence opt3 from neuraminidase__InfluenzaB__AGX22515

SEQ ID NO: 151701 - RNA, 1401 nt, Artificial Sequence
  derived and/or modified sequence opt3 from neuraminidase__InfluenzaB__AGX22526
augcugcccagcaccauccagacacucacucuuuuccugacguccggcgggguguuguuaucucuguacgucucagccagucuaagcuaucuccuguacuccgacauucuucaaaaguuuucucagaccgagauaacagcuccuaucaugccacuggauugcgcaaacgccucgaauguucaggcggugaacagaucagcuacuaaaggaguaaccuugcuccugccggaacccgaguggacauauccuaggcugagcuguccagguaguaccuuccagaaggcccucuuaauuucuccccaccgguuuggcgaaacuaaaggaaauuccgcaccucugaucauucgcgagccauucaucgccugcgggcccacagaauguaagcauuuugcucuuacccacuacgcagcccaaccuggcgguuauuacaacgggacgcgagaggaccguaauaaauugagacaucugauaagcgugaagcuaggaaagaucccaacugucgagaacuccauuuuccacauggcugccuggucaggcagugcgugccaugauggcaaagaauggaccuauaucgggguggacggaccggauagcaaugcacuccugaagauuaaauacggugaggccuacacagacacuuaucacucuuacgcuaagaacauccuuaggacccaggaauccgccuguaauugcauaggcggggauuguuaucugaugauuacagacggacccgcaucaggcaucagcgagugccgguuuuugaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacucaacgucgaaacugacacagccgagauccgacugaugugcaccgagacguauuuagauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcuguauguaaaguacgacggcgaucccuggacagacagugaggcucucgcccuuagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaauuuauugccugauggggucaggacaguugcuaugggacaccgugacuggcgucgauauggcccuguga

SEQ ID NO: 151702 - RNA, 1401 nt, Artificial Sequence; identical to SEQ ID NO: 150804
  derived and/or modified sequence opt3 from neuraminidase__InfluenzaB__AGX22548

SEQ ID NO: 151703 - RNA, 1401 nt, Artificial Sequence; identical to SEQ ID NO: 150643
  derived and/or modified sequence opt3 from neuraminidase__InfluenzaB__AGX22559

SEQ ID NO: 151704 - RNA, 1401 nt, Artificial Sequence; identical to SEQ ID NO: 150804
  derived and/or modified sequence opt3 from neuraminidase__InfluenzaB__AGX22570

SEQ ID NO: 151705 - RNA, 1401 nt, Artificial Sequence
  derived and/or modified sequence opt3 from neuraminidase__InfluenzaB__AGX22581
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccaaggaauguaaacauuuugcuuugacacacuacgcagcccagccuggcgguuauuacaacgggacccgagaggaccguaauaagcugagacaucuaauaagcgugaagcucggaaaaaucccaacggucgagaacuccauuuuccacauggcugccuggucaggcagugcgugccaugauggcagggaauggacuuauaucgggguggacggaccggauaauaacgcacugcuuaagauuaaauacggugaggccuacaccgacacauaucacagcuacgcuaagaauauccugcggacucaagaaucugccuguaacugcauaggcggggauuguuauuugaugauuaccgacggacccgcauccggcaucucagagugccgcuuucucaaaauuagagaggguaggaucaucaaggaaauuuucccuacagggcggguuaagcacaccgaggaauguacgugcggauuugcuagcaauaaaacuauagagugugccugccgcgauaacaauuacacagcgaagcgaccauucgugaaacugaacgucgaaaccgacacugccgagaucagauuaaugugcacagagaccuaucuggauacgcccaggccuaaugacggcaguauuaccggcccaugugaaucuaacggggauaagggauccgguggcaucaaagggggauuugugcaucagcggauggcaagcaagauaggccguugguacucgcgcacaaugucuaaaacuaagagaauggguauggggcucuauguaaaguacgacggcgaccccuggaccgauuccgaggcucuugcccugucaggaguuauggugaguauggaggaaccgggcugguacagcuucggguuugaaauuaaagacaagaaaugcgaugucccuuguaucggaaucgagauggugcacgacgguggcaagacaacuuggcauuccgcugccaccgcaauuuauugcuugauggggucuggacagcuacugugggauacagugaccggcgucgacauggcccucuga

SEQ ID NO: 151706 - RNA, 1401 nt, Artificial Sequence; identical to SEQ ID NO: 150804
  derived and/or modified sequence opt3 from neuraminidase__InfluenzaB__AGX22592

SEQ ID NO: 151707 - RNA, 1401 nt, Artificial Sequence; identical to SEQ ID NO: 150804
  derived and/or modified sequence opt3 from neuraminidase__InfluenzaB__AGX22603

SEQ ID NO: 151708 - RNA, 1401 nt, Artificial Sequence; identical to SEQ ID NO: 151044
  derived and/or modified sequence opt3 from neuraminidase__InfluenzaB__AGX22614

SEQ ID NO: 151709 - RNA, 1401 nt, Artificial Sequence; identical to SEQ ID NO: 150804
  derived and/or modified sequence opt3 from neuraminidase__InfluenzaB__AGX22625

SEQ ID NO: 151710 - RNA, 1401 nt, Artificial Sequence
  derived and/or modified sequence opt3 from neuraminidase__InfluenzaB__AGX22636
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguagcacuccugcugccggaacccgaguggacuuauccuaggcucagcuguccagguaguaccuuccagaaggccuuacugauuucuccccaccgguuuggcgaaacaaaaggaaauuccgcuccucuuaucauucgcgagccauucaucgcaugcgggcccaccgaauguaagcauuuugccuugacucacuacgcugcccagccuggcgguuauuacaacgggacacgagaggaccguaauaaacugagacaucuaauaagcgugaagcucggaaagaucccaaccgucgagaacuccauuuuccacauggcggcauggucaggcagugccugccaugauggcaaagaauggacguauaucgggguggacggaccggauagcaaugcucugcuuaagauuaaauacggugaggccuacacugacaccuaucacucuuacgcaaagaacauccugaggacacaagaauccgcuuguaauugcauaggcggggauuguuauuugaugauuacugacggacccgccucaggcaucagcgagugccgguuucucaaaauucgcgaggguagaaucaucaaggaaauuuucccuaccgggaggguuaagcacacagaggaauguaccugcggauuugcgaguaacaaaacgauagagugugccugccgggauaauucuuacacugcaaagcgcccauucgugaaacugaacgucgaaacagacaccgcugagauccgauuaaugugcacugagacauaucuggauacccccagaccuaaugacggcuccauuacgggcccaugugaaagcgauggggacaagggaucggguggcaucaaagggggauuugugcaucagaggauggccucuaagauaggccggugguacucccguaccaugucaaaaacaaagcgcauggguauggggcucuauguaaaguacgacggcgaucccuggacugacagugaggcucuugcccugagcggaguuaugguguccauggaggaaccgggcugguacucuuucggguuugaaauuaaagauaagaaaugcgacgucccuuguaucggaaucgagauggugcacgaugguggcaagaccacauggcauagcgcagccacugcuauuuauugcuugauggggucaggacagcuacugugggacaccgugacaggcgucgauauggcgcucuga

SEQ ID NO: 151711 - RNA, 1401 nt, Artificial Sequence; identical to SEQ ID NO: 150804
  derived and/or modified sequence opt3 from neuraminidase__InfluenzaB__AGX22647

SEQ ID NO: 151712 - RNA, 1401 nt, Artificial Sequence; identical to SEQ ID NO: 150643
  derived and/or modified sequence opt3 from neuraminidase__InfluenzaB__AGX22658

SEQ ID NO: 151713 - RNA, 1401 nt, Artificial Sequence; identical to SEQ ID NO: 150804
  derived and/or modified sequence opt3 from neuraminidase__InfluenzaB__AGX22669

SEQ ID NO: 151714 - RNA, 1401 nt, Artificial Sequence; identical to SEQ ID NO: 150804
  derived and/or modified sequence opt3 from neuraminidase__InfluenzaB__AGX22680

SEQ ID NO: 151715 - RNA, 1401 nt, Artificial Sequence; identical to SEQ ID NO: 150804
  derived and/or modified sequence opt3 from neuraminidase__InfluenzaB__AGX22691

SEQ ID NO: 151716 - RNA, 1401 nt, Artificial Sequence; identical to SEQ ID NO: 150804
  derived and/or modified sequence opt3 from neuraminidase__InfluenzaB__AGX22702

SEQ ID NO: 151717 - RNA, 1401 nt, Artificial Sequence; identical to SEQ ID NO: 150804
  derived and/or modified sequence opt3 from neuraminidase__InfluenzaB__AGX22713

SEQ ID NO: 151718 - RNA, 1401 nt, Artificial Sequence
  derived and/or modified sequence opt3 from neuraminidase__InfluenzaB__AGX22724
augcugcccagcaccauccagacacucacucuuuuccugacguccggcgggguguuguuaucucuguacgucucagcccuacucaguuaucugcuuuacagcgacauucuguugaaguuuucccaaaccgagauaacagcuccuaucaugccacucgauugcgcaaacgccucuaauguucaggcggugaacagaucggcuacuaaaggaguaacccugcugcucccggaacccgaguggacauauccuagguuaucauguccagguagcaccuuccagaaggcccugcuuauuaguccccaccgguuuggcgaaacuaaaggaaauuccgcaccuuugaucauucgcgagccauucaucgccugcgggcccaaggaauguaaacauuuugcucugacacacuacgcagcccagccuggcgguuauuacaacgggacccgagaggaccguaauaagcuaagacaucucauaucugugaagcugggaaaaaucccaacggucgagaacagcauuuuccacauggcugccugguccggcucagcgugccaugauggcagggaauggacuuauaucgggguggacggaccggauaguaaugcacuucugaagauuaaauacggugaggccuacaccgacacauaucacagcuacgcuaagaacaucuugcggacucaagaaucugccuguaauugcauaggcggggauuguuaucucaugauuaccgacggacccgcauccggcaucucagagugccgcuuucugaaaauuagagaggguaggaucaucaaggaaauuuucccuacagggcggguuaagcacaccgaggaauguacgugcggauuugcuagcaacaaaacuauagagugugccugccgcgauaauaguuacacagcgaagcgaccauucgugaaauuaaacgucgaaaccgacacugccgagaucagacugaugugcacagagaccuaucucgauacgcccaggccuaaugacggcucuauuaccggcccaugugaauccaacggggauaagggaagcgguggcaucaaagggggauuugugcaucagcggauggcaucgaagauaggccguugguacucucgcacaauguccaaaacuaagagaauggguauggggcuuuauguaaaguacgacggcgaccccuggaccgauucagaggcucuggccuugaguggaguuauggugagcauggaggaaccgggcugguacuccuucggguuugaaauuaaagacaagaaaugcgaugucccuuguaucggaaucgagauggugcacgacgguggcaagacaacuuggcauucugcugccaccgcaauuuauugccuaauggggagcggacagcugcucugggauacagugaccggcgucgacauggcccuguga

SEQ ID NO: 151719 - RNA, 1401 nt, Artificial Sequence; identical to SEQ ID NO: 150804
  derived and/or modified sequence opt3 from neuraminidase__InfluenzaB__AGX22735

SEQ ID NO: 151720 - RNA, 1401 nt, Artificial Sequence
  derived and/or modified sequence opt3 from neuraminidase__InfluenzaB__AGX22746
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaaccgaacgcgugaggacagaaauaaacugaggcaucuaauaagcgugaagcucgggaagaucccaacugucgagaacuccauuuuccacauggcugccuggucaggaagugcgugccaugauggcaaagaauggaccuauaucggcguggacgggccggauagcaaugcacugcuuaagauuaaauacggagaggccuacacagacacuuaucacucuuacgcuaagaacauccugcggacccaagaauccgccuguaauugcauagguggcgauuguuauuugaugauuacagacgggcccgcaucaggaaucagcgagugccgcuuucucaaaauuagagagggcaggaucaucaaggaaauuuucccuaccggucggguuaagcacacggaggaauguacuugcggguuugcuaguaacaaaacaauagagugugccugccgcgauaauucuuacaccgcgaagcgaccauucgugaaacugaacgucgaaacugacacagccgagaucagauuaaugugcaccgagacguaucuggauacccccaggccuaaugacggauccauuacaggcccaugugaaagcgauggcgacaaggggucgggagguaucaaaggcggguuugugcaucagcggauggcaucuaagauaggacguugguacucccgcacuaugucaaaaaccaagagaaugggcaugggucucuauguaaaguacgacggggaucccuggacagacagugaggcucuugcccugagcggcguuaugguguccauggaggaaccgggaugguacucuuucggcuuugaaauuaaagauaagaaaugcgacgucccuuguaucgggaucgagauggugcacgauggagguaagacuaccuggcauagcgcugccacagcaauuuauugcuugaugggcucagggcagcuacugugggacaccgugacuggagucgauauggcccucuga

SEQ ID NO: 151721 - RNA, 1401 nt, Artificial Sequence; identical to SEQ ID NO: 150804
  derived and/or modified sequence opt3 from neuraminidase__InfluenzaB__AGX22757

SEQ ID NO: 151722 - RNA, 1401 nt, Artificial Sequence; identical to SEQ ID NO: 150804
  derived and/or modified sequence opt3 from neuraminidase__InfluenzaB__AGX22768

SEQ ID NO: 151723 - RNA, 1401 nt, Artificial Sequence; identical to SEQ ID NO: 151145
  derived and/or modified sequence opt3 from neuraminidase__InfluenzaB__AGX22779

SEQ ID NO: 151724 - RNA, 1401 nt, Artificial Sequence; identical to SEQ ID NO: 150804
  derived and/or modified sequence opt3 from neuraminidase__InfluenzaB__AGX22790

SEQ ID NO: 151725 - RNA, 1401 nt, Artificial Sequence
  derived and/or modified sequence opt3 from neuraminidase__InfluenzaB__AGX22801
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgaggagaccguaauaaacugagacaucuaauaagcgugaagcucggcaagaucccaacggucgagaacuccauuuuccacauggccgcguggucaggcagugcaugccaugaugggaaagaguggacuuauaucggaguggacgguccggauagcaaugcccugcuuaagauuaaauacggcgaggcuuacaccgacacauaucacucuuacgccaagaacauccugaggacucaagaauccgcauguaauugcauagggggaaacuguuauuugaugauuaccgauggcucagcuagcgguguuagugaaugccgguuucucaaaauccgcgaggggagaauuaucaaggagaucuuccccacaggaagggugaagcacaccgaagaguguacgugcggcuuugccucuaauaaaacuauugaaugugcgugccgggacaacuccuacacagccaagcgcccuuucgucaaacugaauguggagaccgauacugcagaaauacgauuaaugugcacagagaccuaucuggacacgccaagacccaacgauggcagcaucaccgggccuugugagucggacggagauaaggguucuggcgggauuaaaggaggcuuuguacaucagaggauggcuuccaagaucggucggugguacucacguacaaugaguaaaacuaagcgcauggggaugggccucuauguuaaguacgacggagacccauggaccgauagcgaagcccuugcucuguccggcgugauggucucuauggaggaacccgggugguacagcuucggauuugagauaaaagacaagaaaugcgaugugccguguauugguaucgaaauggugcacgacggcgggaagacaacuuggcauucagccgcaaccgccaucuauugcuugaugggaaguggccagcuacugugggauacagucaccgguguugacauggcucucuga

SEQ ID NO: 151726 - RNA, 1401 nt, Artificial Sequence; identical to SEQ ID NO: 150804
  derived and/or modified sequence opt3 from neuraminidase__InfluenzaB__AGX22812

SEQ ID NO: 151727 - RNA, 1401 nt, Artificial Sequence; identical to SEQ ID NO: 150804
  derived and/or modified sequence opt3 from neuraminidase__InfluenzaB__AGX22823

SEQ ID NO: 151728 - RNA, 1401 nt, Artificial Sequence; identical to SEQ ID NO: 150804
  derived and/or modified sequence opt3 from neuraminidase__InfluenzaB__AGX22834

SEQ ID NO: 151729 - RNA, 1401 nt, Artificial Sequence; identical to SEQ ID NO: 150804
  derived and/or modified sequence opt3 from neuraminidase__InfluenzaB__AGX22845

SEQ ID NO: 151730 - RNA, 1401 nt, Artificial Sequence; identical to SEQ ID NO: 150804
  derived and/or modified sequence opt3 from neuraminidase__InfluenzaB__AGX22856

SEQ ID NO: 151731 - RNA, 1401 nt, Artificial Sequence; identical to SEQ ID NO: 150804
  derived and/or modified sequence opt3 from neuraminidase__InfluenzaB__AGX22867

SEQ ID NO: 151732 - RNA, 1401 nt, Artificial Sequence; identical to SEQ ID NO: 150804
  derived and/or modified sequence opt3 from neuraminidase__InfluenzaB__AGX22878

SEQ ID NO: 151733 - RNA, 1401 nt, Artificial Sequence
  derived and/or modified sequence opt3 from neuraminidase__InfluenzaB__AGX22889
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucucauacagccaagcgcccauucgugaaacugaacgucgaaaccgacacugcagagauccgauuaaugugcacagagaccuaccuggauacgcccagaccuaaugacggcuccauuaccggcccaugugaaagcgauggggacaagggaucggguggcaucaaagggggauuugugcaccagaggauggcuucuaagauaggccggugguauucccguacaaugucaaaaacuaagcgcauggguauggggcucuacguaaaguaugacggcgaucccuggaccgacagugaggcccuugcucugagcggaguuaugguguccauggaggaaccgggcugguacucuuucggguuugaaauuaaagauaagaaaugcgacgucccuuguaucggaaucgagauggugcaugaugguggcaagacaacuuggcacagcgccgcaaccgccauuuacugcuugauggggucaggacagcuacugugggacacagugaccggcgucgauauggcucucuga

SEQ ID NO: 151734 - RNA, 1401 nt, Artificial Sequence; identical to SEQ ID NO: 150643
  derived and/or modified sequence opt3 from neuraminidase__InfluenzaB__AGX22900

SEQ ID NO: 151735 - RNA, 1401 nt, Artificial Sequence
  derived and/or modified sequence opt3 from neuraminidase__InfluenzaB__AGX22911
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcacaagcgagugccgguuucucaaaauccgcgaggguagaauuaucaaggaaaucuucccuaccgggaggguuaagcacacggaggaauguacuugcggauuugccaguaacaaaacaauugagugugcgugccgggauaauucuuacaccgccaagcgcccauucgugaaacugaacgucgaaacugacacagcagagauacgauuaaugugcaccgagacguaucuggauacccccagaccuaaugacggcuccaucacaggcccaugugaaagcgauggggacaagggaucggguggcauuaaagggggauuugugcaucagaggauggcuucuaagaucggccggugguacucccguacuaugucaaaaaccaagcgcauggguauggggcucuauguaaaguacgacggcgaucccuggacagacagugaggcccuugcucugagcggaguuaugguguccauggaggaaccgggcugguacucuuucggguuugaaauaaaagauaagaaaugcgacgucccuuguauuggaaucgagauggugcacgaugguggcaagacuaccuggcauagcgccgcaacagccaucuauugcuugauggggucaggacagcuacugugggacaccgugacuggcgucgauauggcucucuga

SEQ ID NO: 151736 - RNA, 1401 nt, Artificial Sequence
  derived and/or modified sequence opt3 from neuraminidase__InfluenzaB__AGX22922
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcucuauguaaaguacgacggcgaucccuggacagacaacgaggcucuugcccugaguggaguuauggugagcauggaggaaccgggcugguacuccuucggguuugaaauuaaagauaagaaaugcgacgucccuuguaucggaaucgagauggugcacgaugguggcaagacuaccuggcauucugcugccacagcaauuuauugcuugauggggagcggacagcuacugugggacaccgugacuggcgucgauauggcccucuga

SEQ ID NO: 151737 - RNA, 1401 nt, Artificial Sequence; identical to SEQ ID NO: 150804
  derived and/or modified sequence opt3 from neuraminidase__InfluenzaB__AGX22933

SEQ ID NO: 151738 - RNA, 1401 nt, Artificial Sequence; identical to SEQ ID NO: 150804
  derived and/or modified sequence opt3 from neuraminidase__InfluenzaB__AGX22944

SEQ ID NO: 151739 - RNA, 1401 nt, Artificial Sequence; identical to SEQ ID NO: 150804
  derived and/or modified sequence opt3 from neuraminidase__InfluenzaB__AGX22955

SEQ ID NO: 151740 - RNA, 1401 nt, Artificial Sequence; identical to SEQ ID NO: 150804
  derived and/or modified sequence opt3 from neuraminidase__InfluenzaB__AGX22966

SEQ ID NO: 151741 - RNA, 1401 nt, Artificial Sequence; identical to SEQ ID NO: 150643
  derived and/or modified sequence opt3 from neuraminidase__InfluenzaB__AGX22977

SEQ ID NO: 151742 - RNA, 1401 nt, Artificial Sequence; identical to SEQ ID NO: 151059
  derived and/or modified sequence opt3 from neuraminidase__InfluenzaB__AGX22988

SEQ ID NO: 151743 - RNA, 1401 nt, Artificial Sequence
  derived and/or modified sequence opt3 from neuraminidase__InfluenzaB__AGX22999
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgagugggcauauccuaggcucagcuguccagguaguaccuuccagaaggccuuacugauuucuccccaccgguuuggcgaaacaaaaggaaauuccgcuccucuuaucauucgcgagccauucaucgcaugcgggcccaccgaauguaagcauuuugccuugacucacuacgcugcccagccuggcgguuauuacaacgggacacgagaggaccguaauaaacugagacaucuaauaagcgugaagcucggaaagaucccaaccgucgagaacuccauuuuccacauggcggcauggucaggcagugccugccaugauggcaaagaauggacguauaucgggguggacggaccggauagcaaugcucugcuuaagauuaaauacggugaggccuacacugacaccuaucacucuuacgcaaagaacauccugaggacacaagaauccgcuuguaauugcauaggcggggauuguuauuugaugauuacugacggacccgccucaggcaucagcgagugccgguuucucaaaauucgcgaggguagaaucaucaaggaaauuuucccuaccgggaggguuaagcacacagaggaauguaccugcggauuugcgaguaacaaaacgauagagugugccugccgggauaauucuuacacugcaaagcgcccauucgugaaacugaacgucgaaacagacaccgcugagauccgauuaaugugcacugagacauaucuggauacccccagaccuaaugacggcuccauuacgggcccaugugaaagcgauggggacaagggaucggguggcaucaaagggggauuugugcaucagaggauggccucuaagauaggccggugguacucccguaccaugucaaaaacaaagcgcauggguauggggcucuauguaaaguacgacggcgaucccuggacugacagugaggcucuugcccugagcggaguuaugguguccauggaggaaccgggcugguacucuuucggguuugaaauuaaagauaagaaaugcgacgucccuuguaucggaaucgagauggugcacgaugguggcaagaccacauggcauagcgcagccacugcuauuuauugcuugauggggucaggacagcuacugugggacaccgugacaggcgucgauauggcgcucuga

SEQ ID NO: 151744 - RNA, 1401 nt, Artificial Sequence; identical to SEQ ID NO: 151743
  derived and/or modified sequence opt3 from neuraminidase__InfluenzaB__AGX23010

SEQ ID NO: 151745 - RNA, 1401 nt, Artificial Sequence; identical to SEQ ID NO: 150643
  derived and/or modified sequence opt3 from neuraminidase__InfluenzaB__AGX23021

SEQ ID NO: 151746 - RNA, 1401 nt, Artificial Sequence; identical to SEQ ID NO: 150804
  derived and/or modified sequence opt3 from neuraminidase__InfluenzaB__AGX23032

SEQ ID NO: 151747 - RNA, 1401 nt, Artificial Sequence
  derived and/or modified sequence opt3 from neuraminidase__InfluenzaB__AGX23043
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcucucggcaucucagagugccgguuucugaaaauucgcgaggguagaaucaucaaggaaauuuucccuacagggaggguuaagcacaccgaggaauguacgugcggauuugccagcaacaaaacuauagagugugcgugccgggauaauaguuacacagccaagcgcccauucgugaaauuaaacgucgaaaccgacacugcagagauccgacugaugugcacagagaccuaucucgauacgcccagaccuaaugacggcucuauuaccggcccaugugaauccgauggggacaagggaagcgguggcaucaaagggggauuugugcaucagaggauggcuucgaagauaggccggugguacucucguacaauguccaaaacuaagcgcauggguauggggcuuuauguaaaguacgacggcgaucccuggaccgacucagaggcccuggcuuugaguggaguuauggugagcauggaggaaccgggcugguacuccuucggguuugaaauuaaagauaagaaaugcgacgucccuuguaucggaaucgagauggugcacgaugguggcaagacaacuuggcauucugccgcaaccgccauuuauugccuaauggggagcggacagcugcucugggacacagugaccggcgucgauauggcucuguga

SEQ ID NO: 151748 - RNA, 1401 nt, Artificial Sequence; identical to SEQ ID NO: 150643
  derived and/or modified sequence opt3 from neuraminidase__InfluenzaB__AGX23054

SEQ ID NO: 151749 - RNA, 1401 nt, Artificial Sequence; identical to SEQ ID NO: 150643
  derived and/or modified sequence opt3 from neuraminidase__InfluenzaB__AGX23065

SEQ ID NO: 151750 - RNA, 1401 nt, Artificial Sequence; identical to SEQ ID NO: 150643
  derived and/or modified sequence opt3 from neuraminidase__InfluenzaB__AGX23076

SEQ ID NO: 151751 - RNA, 1401 nt, Artificial Sequence; identical to SEQ ID NO: 150804
  derived and/or modified sequence opt3 from neuraminidase__InfluenzaB__AGX23087

SEQ ID NO: 151752 - RNA, 1401 nt, Artificial Sequence; identical to SEQ ID NO: 150643
  derived and/or modified sequence opt3 from neuraminidase__InfluenzaB__AGX23098

SEQ ID NO: 151753 - RNA, 1401 nt, Artificial Sequence
  derived and/or modified sequence opt3 from neuraminidase__InfluenzaB__AGX23109
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauacggggcgauuguuauuugaugauuacagacgggcccgcaucaggaaucagcgagugccgcuuucucaaaauuagagagggcaggaucaucaaggaaauuuucccuaccggucggguuaagcacacggaggaauguacuugcggguuugcuaguaacaaaacaauagagugugccugccgcgauaauucuuacaccgcgaagcgaccauucgugaaacugaacgucgaaacugacacagccgagaucagauuaaugugcaccgagacguaucuggauacccccaggccuaaugacggauccauuacaggcccaugugaaagcgauggcgacaaggggucgggagguaucaaaggcggguuugugcaucagcggauggcaucuaagauaggacguugguacucccgcacuaugucaaaaaccaagagaaugggcaugggucucuauguaaaguacgacggggaucccuggacagacagugaggcucuugcccugagcggcguuaugguguccauggaggaaccgggaugguacucuuucggcuuugaaauuaaagauaagaaaugcgacgucccuuguaucgggaucgagauggugcacgauggagguaagacuaccuggcauagcgcugccacagcaauuuauugcuugaugggcucagggcagcuacugugggacaccgugacuggagucgauauggcccucuga

SEQ ID NO: 151754 - RNA, 1401 nt, Artificial Sequence; identical to SEQ ID NO: 150804
  derived and/or modified sequence opt3 from neuraminidase__InfluenzaB__AGX23120

SEQ ID NO: 151755 - RNA, 1401 nt, Artificial Sequence
  derived and/or modified sequence opt3 from neuraminidase__InfluenzaB__AGX23131
augcugcccagcaccauccagacacucacucuuuuccugacguccggcgggguguuguuaucucuguacgucucagccagucuaagcuaucuccuguacuccgacauucuucugaaguuuucucaaaccgagauaaucgcuccuauuaugccauuggauugcgcaaacgccucgaauguucaggcggugaacagaucagcugccaaaggaguaacacuccugcugccggaacccgaguggacuuauccuaggcucagcuguccagguaguaccuuccagaaggcauuacugaucucuccccaccgguuuggcgaaacaaaaggaaauuccgccccucuuauuauccgcgagccauucauagcuugcgggcccaccgaauguaagcauuuugcauugacucacuacgccgcucagccuggcgguuauuacaacgggacacgagaggaccguaauaaacugagacaucuaaucagcgugaagcucggaaagauuccaaccgucgagaacuccaucuuccacauggccgcguggucaggcagugcaugccaugauggcaaagaauggacguauauugggguggacggaccggauagcaaugcccugcuuaagaucaaauacggugaggcuuacacugacaccuaucacucuuacgccaagaacauacugaggacacaagaauccgcauguaauugcauuggcggggauuguuauuugaugaucacugacggacccgcuucaggcauuagcgagugccgguuucucaaaauccgcgaggguagaaucauuaaggaaauauucccuaccgggaggguuaagcacacagaggaauguaccugcggauuugccaguaacaaaacgaucgagugugcgugccgggauaauucuuacacugccaagcgcccauucgugaaacugaacgucgaaacagacaccgcagagauucgauuaaugugcacugagacauaucuggauacccccagaccuaaugacggcuccaucacgggcccaugugaaagcgauggggacaagggaucggguggcauaaaagggggauuugugcaucagaggauggcuucuaagauuggccggugguacucccguaccaugucaaaaacaaagcgcauggguauggggcucuauguaaaguacgacggcgaucccuggacugacagugaggcccuugcucugagcggaguuaugguguccauggaggaaccgggcugguacucuuucggguuugaaaucaaagauaagaaaugcgacgucccuuguaucggaauugagauggugcacgaugguggcaagaccacauggcauagcgccgcaacugccaucuauugcuugauggggucaggacagcuacugugggacaccgugacaggcgucgauauggcucucuga

SEQ ID NO: 151756 - RNA, 1401 nt, Artificial Sequence; identical to SEQ ID NO: 150804
  derived and/or modified sequence opt3 from neuraminidase__InfluenzaB__AGX23142

SEQ ID NO: 151757 - RNA, 1401 nt, Artificial Sequence; identical to SEQ ID NO: 150643
  derived and/or modified sequence opt3 from neuraminidase__InfluenzaB__AGX23153

SEQ ID NO: 151758 - RNA, 1401 nt, Artificial Sequence; identical to SEQ ID NO: 150643
  derived and/or modified sequence opt3 from neuraminidase__InfluenzaB__AGX23164

SEQ ID NO: 151759 - RNA, 1401 nt, Artificial Sequence; identical to SEQ ID NO: 150643
  derived and/or modified sequence opt3 from neuraminidase__InfluenzaB__AGX23175

SEQ ID NO: 151760 - RNA, 1401 nt, Artificial Sequence
  derived and/or modified sequence opt3 from neuraminidase__InfluenzaB__AGX23186
augcugcccagcaccacacagacucucacgcuuuuccugaccuccggcgggguguuguuaucucuguacgucucagccagucuaagcuaucuccuguacuccgacauccuucugaaguuuucucaaacagagauuacugcuccuauaaugccauuggauugcgcaaacgccucgaauguucaggcggugaacagaucagcugccaaaggaguaacccuccugcugccggaacccgaguggacauauccuaggcucagcuguccagguaguaccuuccagaaggcauuacugaucucuccccaccgguuuggcgaaacuaaaggaaauuccgccccucuuauuauccgcgagccauucauugcuugcgggcccacagaauguaagcauuuugcauugacccacuacgccgcucagccuggcgguuauuacaacgggacgcgagaggaccguaauaaacugagacaucuaaucagcgugaagcucggaaagauaccaacugucgagaacuccaucuuccacauggccgcguggucaggcagugcaugccaugauggcaaagaauggaccuauauugggguggacggaccggauagcaaugcccugcuuaagaucaaauacggugaggcuuacacagacacuuaucacucuuacgccaagaacauucugaggacccaagaauccgcauguaauugcaucggcggggauuguuauuugaugauaacagacggacccgcuucaggcauuagcgagugccgguuucucaaaauccgcgaggguagaauuaucaaggaaaucuucccuaccgggaggguuaagcacacggaggaauguacuugcggauuugccaguaacaaaacaauugagugugcgugccgggauaauucuuacaccgccaagcgcccauucgugaaacugaacgucgaaacugacacagcagagauacgauuaaugugcaccgagacguaucuggauacccccagaccuaaugacggcuccaucacaggcccaugugaaagcgauggggacaagggaucggguggcauuaaagggggauuugugcaucagaggauggcuucuaagaucggccggugguacucccguacuaugucaaaaaccaagcgcauggguauggggcucuauguaaaguacgacggcgaucccuggacagacagugaggcccuugcucugagcggaguuaugguguccauggaggaaccgggcugguacucuuucggguuugaaauaaaagauaagaaaugcgacgucccuuguauuggaaucgagauggugcacgaugguggcaagacuaccuggcauagcgccgcaacagccaucuauugcuugauggggucaggacagcuacugugggacaccgugacuggcgucgauauggcucucuga

SEQ ID NO: 151761 - RNA, 1401 nt, Artificial Sequence; identical to SEQ ID NO: 150804
  derived and/or modified sequence opt3 from neuraminidase__InfluenzaB__AGX23197

SEQ ID NO: 151762 - RNA, 1401 nt, Artificial Sequence; identical to SEQ ID NO: 150804
  derived and/or modified sequence opt3 from neuraminidase__InfluenzaB__AGX23208

SEQ ID NO: 151763 - RNA, 1401 nt, Artificial Sequence; identical to SEQ ID NO: 150804
  derived and/or modified sequence opt3 from neuraminidase__InfluenzaB__AGX23219

SEQ ID NO: 151764 - RNA, 1401 nt, Artificial Sequence
  derived and/or modified sequence opt3 from neuraminidase__InfluenzaB__AGX23230
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgaguauuacaacgguacccgagaggaccguaauaaacugagacaucuaauaagcgugaagcucgggaagaucccaacggucgaaaacuccauuuuccacauggccgcguggucaggaagugcaugccaugauggcaaagaguggacuuauaucggcguggacgggccggauagcaaugcccugcuuaagauuaaauacggagaggcuuacaccgacacauaucacucuuacgccaagaacauccugaggacucaagaauccgcauguaauugcauagguggcgauuguuauuugaugauuaccgacgggcccucaagcggaaucagugagugccgguuucucaaaauucgcgaaggcagaaucaucaaggagauuuucccuacagguaggguuaagcacaccgaagaguguacgugcggguuugcuucuaacaaaacuauagaaugugccugccgggauaauuccuacacagcgaagcgcccauucgugaaacugaacgucgagaccgacacugccgagauccgauuaaugugcacagaaaccuaucuggauacgcccagaccuaaugacggaagcauuaccggcccaugugagucggauggcgacaaggggucuggagguaucaaaggcggguuugugcaucagaggauggcauccaagauaggacggugguacucacguacaaugaguaaaacuaagcgcaugggcaugggucucuauguaaaguacgacggggaucccuggaccgacagcgaagcucuugcccuguccggcguuauggugucuauggaggaaccgggaugguacagcuucggcuuugagauuaaagauaagaaaugcgacgucccuuguaucgggaucgagauggugcacgauggagguaagacaacuuggcauucagcugccaccgcaauuuauugcuugaugggcagugggcagcuacugugggacacagugaccggagucgauauggcccucuga

SEQ ID NO: 151765 - RNA, 1401 nt, Artificial Sequence; identical to SEQ ID NO: 150643
  derived and/or modified sequence opt3 from neuraminidase__InfluenzaB__AGX23241

SEQ ID NO: 151766 - RNA, 1401 nt, Artificial Sequence; identical to SEQ ID NO: 150804
  derived and/or modified sequence opt3 from neuraminidase__InfluenzaB__AGX23252

SEQ ID NO: 151767 - RNA, 1401 nt, Artificial Sequence; identical to SEQ ID NO: 150804
  derived and/or modified sequence opt3 from neuraminidase__InfluenzaB__AGX23263

SEQ ID NO: 151768 - RNA, 1401 nt, Artificial Sequence; identical to SEQ ID NO: 150804
  derived and/or modified sequence opt3 from neuraminidase__InfluenzaB__AGX23274

SEQ ID NO: 151769 - RNA, 1401 nt, Artificial Sequence; identical to SEQ ID NO: 150643
  derived and/or modified sequence opt3 from neuraminidase__InfluenzaB__AGX23285

SEQ ID NO: 151770 - RNA, 1401 nt, Artificial Sequence; identical to SEQ ID NO: 150804
  derived and/or modified sequence opt3 from neuraminidase__InfluenzaB__AGX23296

SEQ ID NO: 151771 - RNA, 1401 nt, Artificial Sequence
  derived and/or modified sequence opt3 from neuraminidase__InfluenzaB__AGX23307
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgccaagaacauucugaggacucaagaauccgcauguaauugcaucggcggggauuguuauuugaugauaaccgacggacccgcuucaggcauuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaaaaacuaagcgcauggguauggggcucuauguuaaguacgacggcgaucccuggaccgacagugaggcccuugcucugagcggagugauggucuccauggaggaaccgggcugguacucuuucggguuugaaauaaaagauaagaaaugcgacgugccuuguauuggaaucgagauggugcacgaugguggcaagacaacuuggcauagcgccgcaaccgccaucuauugcuugauggggucaggacagcuacugugggacacagucaccggcguugauauggcucucuga

SEQ ID NO: 151772 - RNA, 1401 nt, Artificial Sequence; identical to SEQ ID NO: 151771
  derived and/or modified sequence opt3 from neuraminidase__InfluenzaB__AGX23318

SEQ ID NO: 151773 - RNA, 1401 nt, Artificial Sequence; identical to SEQ ID NO: 151771
  derived and/or modified sequence opt3 from neuraminidase__InfluenzaB__AGX23329

SEQ ID NO: 151774 - RNA, 1401 nt, Artificial Sequence; identical to SEQ ID NO: 151771
  derived and/or modified sequence opt3 from neuraminidase__InfluenzaB__AGX23340

SEQ ID NO: 151775 - RNA, 1401 nt, Artificial Sequence; identical to SEQ ID NO: 151771
  derived and/or modified sequence opt3 from neuraminidase__InfluenzaB__AGX23351

SEQ ID NO: 151776 - RNA, 1401 nt, Artificial Sequence; identical to SEQ ID NO: 151771
  derived and/or modified sequence opt3 from neuraminidase__InfluenzaB__AGX23362

SEQ ID NO: 151777 - RNA, 1401 nt, Artificial Sequence; identical to SEQ ID NO: 151771
  derived and/or modified sequence opt3 from neuraminidase__InfluenzaB__AGX23373

SEQ ID NO: 151778 - RNA, 1401 nt, Artificial Sequence; identical to SEQ ID NO: 151771
  derived and/or modified sequence opt3 from neuraminidase__InfluenzaB__AGX23384

SEQ ID NO: 151779 - RNA, 1401 nt, Artificial Sequence
  derived and/or modified sequence opt3 from neuraminidase__InfluenzaB__AGX23395
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgccaagaacauucugaggacucaagaauccgcauguaauugcaucggcggggauuguuauuugaugauaaccgacggacccgcuucaggcauuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaaaaacuaagcgcauggguauggggcucuauguuaaguacgacggcgaucccuggaccgacagugaggcccuugcucugagcggagugauggucuccauggaggaaccgggcugguacucuuucggguuugaaauaaaagauaagaaaugcgacgugccuuguauuggaaucgagauggugcacgaugguggcaagacaacuuggcauagcgccgcaaccgccaucuauugcuugauggggucaggacagcuacuguggaacacagucaccggcguugacauggcucucuga

SEQ ID NO: 151780 - RNA, 1401 nt, Artificial Sequence
  derived and/or modified sequence opt3 from neuraminidase__InfluenzaB__AGX23417
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacuuuccuccugccggaacccgaguggaccuauccuaggcugagcuguccagguaguacauuucagaaggcacucuuaauuucuccccaccgguucggcgaaaccaaaggaaauuccgccccucugaucauucgcgagccauuuaucgcuugcgggcccacugaauguaagcauuucgcacuuacacacuacgccgcucagccuggcgguuauuacaacgggacccgagaggaccguaauaaauugagacaucugauaagcgugaagcuaggaaagaucccaacggucgagaacuccauuuuucacauggccgcguggucaggcagugcaugccaugauggcaaagaauggacuuauaucgggguggacggaccggauagcaaugcccuccugaagauuaaauacggugaggcuuacaccgacacauaucacucuuacgccaagaacauccuuaggacucaagaauccgcauguaauugcauaggcggggauuguuaucugaugauuaccgacggacccgcuucaggcaucagcgagugccgguucuugaaaauucgcgaggguagaaucaucaaggaaauuuuuccuacagggaggguuaagcacaccgaggaauguacgugcggauucgccaguaacaaaacuauagagugugcgugccgggauaauucuuacacagccaagcgcccauuugugaaacucaacgucgaaaccgacacugcagagauccgacugaugugcacagagaccuauuuagauacgcccagaccuaaugacggcuccauuaccggcccaugugaaagcgauggggacaagggaucggguggcaucaaagggggauucgugcaucagaggauggcuucuaagauaggccggugguacucccguacaaugucaaaaacuaagcgcauggguauggggcuguauguaaaguacgacggcgaucccuggaccgacagugaggcccucgcucuuagcggaguuaugguguccauggaggaaccgggcugguacucuuuuggguucgaaauuaaagauaagaaaugcgacgucccuuguaucggaaucgagauggugcacgaugguggcaagacaacuuggcauagcgccgcaaccgccauuuauugccugauggggucaggacaguugcuaugggacacagugaccggcgucgauauggcucuguga

SEQ ID NO: 151781 - RNA, 1401 nt, Artificial Sequence; identical to SEQ ID NO: 151780
  derived and/or modified sequence opt3 from neuraminidase__InfluenzaB__AGX23428

SEQ ID NO: 151782 - RNA, 1401 nt, Artificial Sequence; identical to SEQ ID NO: 151163
  derived and/or modified sequence opt3 from neuraminidase__InfluenzaB__AGX23450

SEQ ID NO: 151783 - RNA, 1401 nt, Artificial Sequence
  derived and/or modified sequence opt3 from neuraminidase__InfluenzaB__AGX23461
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauauucaagcgguuaacaggucagcuacuaaaggagugacccuccugcugccggaacccgaguggacauauccucggcucagcuguccagguaguaccuuccagaaggccuuacugaucucuccccaccgcuuuggcgaaacuaaaggaaauuccgcaccucuuauuauccgagagccauucauagccugcgggcccaaggaauguaaacauuuugcuuugacacacuacgcagcccagccuggcgguuauuacaacgggacccgugaggacagaaauaagcugaggcaucuaaucagcguaaagcucggaaaaauuccaacgguggagaacuccaucuuccacauggcugccuggucaggcagugcgugccaugauggccgggaauggacuuauauuggggucgacggaccggauagcaaugcacugcuuaagaucaaauacggugaggccuacaccgacacauaucacucuuacgcuaagaacauacugcgcacucaggaauccgccuguaauugcauuggcggggauuguuauuugaugaucaccgacggacccgcaucaggcauuagcgagugcagauuucucaaaaucagggagggucggaucauuaaggaaauauucccuacagggcgcgugaagcacaccgaggaauguacgugcggauuugcuaguaacaaaacuaucgagugugccugccgagauaauucuuacacagcgaagagaccauucguuaaacugaacguggaaaccgacacugccgagauuagguuaaugugcacagagaccuaucuggauacgccccggccuaaugacggcuccaucaccggcccaugugaaagcaacggggauaagggaucggguggcauaaaagggggauuuguccaucaacguauggcaucuaagauuggccgcugguacuccagaacaaugucaaaaacuaagaggauggguauggggcucuaugugaaguacgacggcgaccccuggaccgauagugaggcucuugcccugagcggaguaaugguuuccaucgaggaaccgggcugguacucuuucggguuugaaaucaaagacaagaaaugcgaugugccuuguauuggaaucgagaugguccacgacgguggcaagacaacuuggcauagcgcugccaccgcaauuuauugcuugauggggucaggacagcuacugugggauacagugaccggcguggacauggcccucuga

SEQ ID NO: 151784 - RNA, 1401 nt, Artificial Sequence; identical to SEQ ID NO: 151163
  derived and/or modified sequence opt3 from neuraminidase__InfluenzaB__AGX23472

SEQ ID NO: 151785 - RNA, 1401 nt, Artificial Sequence; identical to SEQ ID NO: 150804
  derived and/or modified sequence opt3 from neuraminidase__InfluenzaB__AGX23483

SEQ ID NO: 151786 - RNA, 1401 nt, Artificial Sequence
  derived and/or modified sequence opt3 from neuraminidase__InfluenzaB__AGX23494
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgccaagaacauucugaggacucaagaauccgcauguaauugcaucggcggggauuguuauuugaugauaaccgacggacccgcuucaggcauuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugggagcgauggagacaaggguucgggcgggauuaaaggaggcuuuguacaucagaggauggcuucuaagaucggucggugguacucccguacaaugucaaaaacuaagcgcauggggaugggccucuauguuaaguacgacggagaucccuggaccgacagugaagcccuugcucugagcggcgugauggucuccauggaugagccggggugguacucuuucggauuugaaauaaaagacaagaaaugcgaugugccuuguauugguaucgagauggugcacgacggcgggaagacaacuuggcauagcgccgcaaccgccaucuauugcuugaugggaucaggccagcuacugugggauacagucaccgguguugacauggcucucuga

SEQ ID NO: 151787 - RNA, 1401 nt, Artificial Sequence
  derived and/or modified sequence opt3 from neuraminidase__InfluenzaB__AGX23505
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauaauaacgcccugcuuaagauuaaauacggugaggcuuacaccgacacauaucacagcuacgccaagaauauccugaggacucaagaaucugcauguaacugcauaggcggggauuguuauuugaugauuaccgacggacccgcuuccggcaucucagagugccgguuucucaaaauucgcgaggguagaaucaucaaggaaauuuucccuacagggaggguuaagcacaccgaggaauguacgugcggauuugccagcaauaaaacuauagagugugcgugccgggauaacaguuacacagccaagcgcccauucgugaaacugaaugucgaaaccgacacugcagagauccgauuaaugugcacagagaccuaucuggauacgcccagaccuaacgacggcucuauuaccggcccaugugaauccgauggggacaagggaagcgguggcaucaaagggggauuugugcaucagaggauggcuucgaagauaggccggugguacucucguacaauguccaaaacuaagcgcauggguauggggcucuauguaaaguacgacggcgaucccuggaccgacucagaggcccuugcucugaguggaguuauggugagcauggaggaaccgggcugguacuccuucggguuugaaauuaaagauaagaaaugcgacgucccuuguaucggaaucgagauggugcacgaugguggcaagacaacuuggcauucugccgcaaccgccauuuauugcuugauggggagcggacagcuacugugggacacagugaccggcgucgauauggcucucuga

SEQ ID NO: 151788 - RNA, 1401 nt, Artificial Sequence
  derived and/or modified sequence opt3 from neuraminidase__InfluenzaB__AGX23516
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcguuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaaaagccaagcgcauggguauggggcucuauguuaaguacgacggcgaucccuggacugacagugaggcucuugcccugagcggagugauggucuccauggaggaaccgggcugguacucuuucggguuugaaauaaaagauaagaaaugcgacgugccuuguauuggaaucgagauggugcacgaugguggcaagaccacauggcauagcgcagccacugcuaucuauugcuugauggggucaggacagcuacugugggacaccgucacaggcguugauauggcgcucuga

SEQ ID NO: 151789 - RNA, 1401 nt, Artificial Sequence; identical to SEQ ID NO: 150804
  derived and/or modified sequence opt3 from neuraminidase__InfluenzaB__AGX23527

SEQ ID NO: 151790 - RNA, 1401 nt, Artificial Sequence
  derived and/or modified sequence opt3 from neuraminidase__InfluenzaB__AGX23538
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccgaagcccgaauggaccuauccuaggcucagcuguccagguaguacauuccagaaagcauuacugauuucuccccaccgguuuggcgagaccaagggaaauuccgccccucuuaucauucgcgaaccauucaucgcuugcgggcccacugaguguaaacauuuugcauugacacacuacgccgcucagccuggcgguuauuacaacgggacccgagaagaccguaauaagcugagacaucuaauaagcgugaagcucggaaaaaucccaacggucgagaacuccauuuuccacauggccgcguggucaggcagugcaugccaugauggcaaggaguggacuuauaucgggguggacggaccggauagcaaugcccugcuuaaaauuaaguacggugaggcuuacaccgacacauaucacucuuacgccaaaaacauccugaggacucaagaauccgcauguaauugcauaggcggggauuguuauuugaugauuaccgacggacccgcuucaggcguuagcgaaugccgguuucucaagauccgcgaggguagaauuaucaaggagaucuucccuacagggagggugaaacacaccgaagaguguacgugcggauuugccaguaacaagacuauugaaugugcgugccgggauaauucuuacacagccaaacgcccauucgucaagcugaacguggagaccgacacugcagaaauacgauuaaugugcacagagaccuaucuggauacgcccagaccuaaugacggcuccaucaccggcccaugugagagcgauggggacaaaggaucggguggcauuaaagggggauuuguacaucagaggauggcuucuaagaucggccggugguacucccguacaaugucaacuaccaagcgcauggguauggggcucuauguuaaguacgacggcgaucccuggacagacagugaagcccuugcucugagcggagugauggucuccauggaggaaccgggcugguacucuuucggguuugagauaaaagauaagaaaugcgacgugccuuguauuggaaucgaaauggugcacgaugguggcaagacuaccuggcauagcgccgcaacagccaucuauugcuugauggggucaggacagcuacugugggacaccgucacuggcguugauauggcucucuga

SEQ ID NO: 151791 - RNA, 1401 nt, Artificial Sequence
  derived and/or modified sequence opt3 from neuraminidase__InfluenzaB__AGX23549
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcguuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaacuaccaaacgcauggguauggggcucuauguuaaguacgacggcgaucccuggacagacagugaggcccuugcucugagcggagugauggucuccauggaggaaccgggcugguacucuuucggguuugaaauaaaggauaaaaagugcgacgugccuuguauuggaaucgagauggugcacgaugguggcaaaacuaccuggcauagcgccgcaacagccaucuauugcuugauggggucaggacagcuacugugggacaccgucacuggcguugauauggcucucuga

SEQ ID NO: 151792 - RNA, 1401 nt, Artificial Sequence; identical to SEQ ID NO: 150804
  derived and/or modified sequence opt3 from neuraminidase__InfluenzaB__AGX23560

SEQ ID NO: 151793 - RNA, 1401 nt, Artificial Sequence; identical to SEQ ID NO: 151786
  derived and/or modified sequence opt3 from neuraminidase__InfluenzaB__AGX23571

SEQ ID NO: 151794 - RNA, 1401 nt, Artificial Sequence; identical to SEQ ID NO: 151786
  derived and/or modified sequence opt3 from neuraminidase__InfluenzaB__AGX23582

SEQ ID NO: 151795 - RNA, 1401 nt, Artificial Sequence
  derived and/or modified sequence opt3 from neuraminidase__InfluenzaB__AGX23593
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuuacacugagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaauuuauugcuugauggggucaggacagcuacugugggacaccgugacuggcgucgauauggcccucuga

SEQ ID NO: 151796 - RNA, 1401 nt, Artificial Sequence; identical to SEQ ID NO: 150804
  derived and/or modified sequence opt3 from neuraminidase__InfluenzaB__AGX23604

SEQ ID NO: 151797 - RNA, 1401 nt, Artificial Sequence
  derived and/or modified sequence opt3 from neuraminidase__InfluenzaB__AGX23615
augcugcccagcaccauccagacacucacucuuuuccugacguccggcgggguguuguuaucucuguacgucucagccagucuaagcuaucuccuguacuccgacauucuucugaaguuuucucaaaccgagauaacaacuccuaucaugccauuggauugcgcuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaacuaaaggaaauuccgcaccucuuaucauucgcgagccauucaucgccugcgggcccacagaauguaagcauuuugcuuugacccacuacgcagcccagccuggcgguuauuacaacgggacgcgagaggaccguaauaaacugagacaucuaauaagcgugaagcucggaaagaucccaacugucgagaacuccauuuuccacauggcugccuggucaggcagugcgugccaugauggcaaagaauggaccuauaucgggguggacggaccggauagcaaugcacugcuuaagauuaaauacggugaggccuacacagacacuuaucacucuuacgcuaagaacauccugaggacccaagaauccgccuguaauugcauaggcggggauuguuauuugaugauuacagacggacccgcaucaggcaucagcgagugccgguuucucaaaauucgcgaggguagaaucaucaaggaaauuuucccuaccgggaggguuaagcacacggaggaauguacuugcggauuugcuaguaacaaaacaauagagugugccugccgggauaauucuuacaccgcgaagcgcccauucgugaaacugaacgucgaaacugacacagccgagauccgauuaaugugcaccgagacguaucuggauacccccagaccuaaugacggcuccauuacaggcccaugugaaagcgauggggacaagggaucggguggcaucaaagggggauuugugcaucagaggauggcaucuaagauaggccggugguacucccguacuaugucaaaaaccaagcgcauggguauggggcucuauguaaaguacgacggcgaucccuggacagacagugaggcucuugcccugagcggaguuaugguguccauggaggaaccgggcugguacucuuucggguuugaaauuaaagauaagaaaugcgacgucccuuguaucggaaucgagauggugcacgaugguggcaagacuaccuggcauagcgcugccacagcaauuuauugcuugauggggucaggacagcuacugugggacaccgugacuggcgucgauauggcccucuga

SEQ ID NO: 151798 - RNA, 1401 nt, Artificial Sequence; identical to SEQ ID NO: 151786
  derived and/or modified sequence opt3 from neuraminidase__InfluenzaB__AGX23626

SEQ ID NO: 151799 - RNA, 1401 nt, Artificial Sequence; identical to SEQ ID NO: 151163
  derived and/or modified sequence opt3 from neuraminidase__InfluenzaB__AGX23637

SEQ ID NO: 151800 - RNA, 1401 nt, Artificial Sequence; identical to SEQ ID NO: 150804
  derived and/or modified sequence opt3 from neuraminidase__InfluenzaB__AGX23659

SEQ ID NO: 151801 - RNA, 1401 nt, Artificial Sequence; identical to SEQ ID NO: 151163
  derived and/or modified sequence opt3 from neuraminidase__InfluenzaB__AGX23670

SEQ ID NO: 151802 - RNA, 1401 nt, Artificial Sequence; identical to SEQ ID NO: 151163
  derived and/or modified sequence opt3 from neuraminidase__InfluenzaB__AGX23681

SEQ ID NO: 151803 - RNA, 1401 nt, Artificial Sequence; identical to SEQ ID NO: 151163
  derived and/or modified sequence opt3 from neuraminidase__InfluenzaB__AGX23692

SEQ ID NO: 151804 - RNA, 1401 nt, Artificial Sequence; identical to SEQ ID NO: 151163
  derived and/or modified sequence opt3 from neuraminidase__InfluenzaB__AGX23703

SEQ ID NO: 151805 - RNA, 1401 nt, Artificial Sequence
  derived and/or modified sequence opt3 from neuraminidase__InfluenzaB__AGX23714
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgaaaagaacauucugaggacucaagaguccgccuguaauugcaucggcggggauuguuauuugaugauaaccgacggacccgcaucaggcauuagcgagugccgguuucucaaaauccgcgaagguagaauuaucaaggagaucuucccuacagggagggugaagcacaccgaagaguguacgugcggauuugcuaguaacaaaacuauugaaugugccugccgggauaauucuuacacagcgaagcgcccauucgucaaacugaacguggagaccgacacugccgagauacgauuaaugugcacagaaaccuaucuggauacgcccagaccuaaugacggcuccaucaccggcccaugugggagcgauggagacaaggguucgggcgggauuaaaggaggcuuuguacaucagaggauggcaucuaagaucggucggugguacucccguacaaugucaaaaacuaagcgcauggggaugggccucuauguuaaguacgacggagaucccuggaccgacagugaggcucuugcccugagcggcgugauggucuccauggaugaaccggggugguacucuuucggauuugagauaaaagacaagaaaugcgaugugccuuguauugguaucgaaauggugcacgacggcgggaagacaacuuggcauagcgcugccaccgcaaucuauugcuugaugggaucaggccagcuacugugggauacagucaccgguguugacauggcccucuga

SEQ ID NO: 151806 - RNA, 1401 nt, Artificial Sequence; identical to SEQ ID NO: 151163
  derived and/or modified sequence opt3 from neuraminidase__InfluenzaB__AGX23725

SEQ ID NO: 151807 - RNA, 1401 nt, Artificial Sequence; identical to SEQ ID NO: 151786
  derived and/or modified sequence opt3 from neuraminidase__InfluenzaB__AGX23736

SEQ ID NO: 151808 - RNA, 1401 nt, Artificial Sequence; identical to SEQ ID NO: 151163
  derived and/or modified sequence opt3 from neuraminidase__InfluenzaB__AGX23747

SEQ ID NO: 151809 - RNA, 1401 nt, Artificial Sequence; identical to SEQ ID NO: 151163
  derived and/or modified sequence opt3 from neuraminidase__InfluenzaB__AGX23758

SEQ ID NO: 151810 - RNA, 1401 nt, Artificial Sequence; identical to SEQ ID NO: 151786
  derived and/or modified sequence opt3 from neuraminidase__InfluenzaB__AGX23769

SEQ ID NO: 151811 - RNA, 1401 nt, Artificial Sequence
  derived and/or modified sequence opt3 from neuraminidase__InfluenzaB__AGX23780
augcugcccagcaccauccagacacucacucuucuguugacguccggcgggguguuacugucucuauacgucucagccagucucagcuaucugcuuuacuccgacauucuguugaaguucucucaaaccgagauaacagcuccuaucaugccacucgauugcgcaaacgccucgaauguucaggcggugaacagaucagcugccaaaggaguaacucugcugcucccggaacccgaguggaccuauccuagguuaagcuguccagguaguacauuucagaaggcacugcuuauuucuccccaccgguucggcgaaaccaaaggaaauuccgccccuuugaucauucgcgagccauuuaucgcuugcgggcccacugaauguaagcauuucgcacugacacacuacgccgcucagccuggcgguuauuacaacgggacccgagaggaccguaauaaacuaagacaucucauaagcgugaagcugggaaagaucccaacggucgagaacuccauuuuucacauggccgcguggucaggcagugcaugccaugauggcaaagaauggacuuauaucgggguggacggaccggauagcaaugcccuucugaagauuaaauacggugaggcuuacaccgacacauaucacucuuacgccaagaacaucuugaggacucaagaauccgcauguaauugcauaggcggggauuguuaucucaugauuaccgacggacccgcuucaggcguuagcgagugccgguuccugaaaauccgcgaggguagaauuaucaaggaaaucuuuccuacagggagggugaagcacaccgaggaauguacgugcggauucgccaguaacaaaacuauugagugugcgugccgggauaauucuuacacagccaagcgcccauuugucaaauuaaacguggaaaccgacacugcagagauacgacugaugugcacagagaccuaucucgauacgcccagaccuaaugacggcuccaucaccggcccaugugaaagcgauggggacaagggaucggguggcauuaaagggggauucguacaucagaggauggcuucuaagaucggccggugguacucccguacaaugucaaaaacuaagcgcauggguauggggcuuuauguuaaguacgacggcgaucccuggaccgacagugaggcccuggcuuugagcggagugauggucuccauggaggaaccgggcugguacucuuuuggguucgaaauaaaagauaagaaaugcgacgugccuuguauuggaaucgagauggugcacgaugguggcaagacaacuuggcauagcgccgcaaccgccaucuauugccuaauggggucaggacagcugcucugggacacagucaccggcguugauauggcucuguga

SEQ ID NO: 151812 - RNA, 1401 nt, Artificial Sequence
  derived and/or modified sequence opt3 from neuraminidase__InfluenzaB__AGX23791
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaaugcgcaggcuguuaacagaucagccgcaaaaggagugacucuccugcugccggaacccgaguggaccuauccuaggcucagcuguccagguaguacauuccagaaggccuuacugauuucuccccaccgguuuggcgaaaccaaaggaaauuccgcuccucuuaucauucgcgagccauucaucgcaugcgggcccacugaauguaagcauuuugccuugacacacuacgcugcccagccuggcgguuauuacaacgggacccgagaggaccguaauaaacugagacaucuaauaagcguaaagcucggaaagaucccaacgguggagaacuccauuuuccacauggcggcauggucaggcagugccugccaugauggcaaagaauggacuuauaucggggucgacggaccggauagcaaugcucugcuuaagauuaaauacggugaggccuacaccgacacauaucacucuuacgcaaagaacauccugaggacucaagaauccgcuuguaauugcauaggcggggauuguuauuugaugauuaccgacggacccgccucaggcgugagcgagugccgguuucucaaaauccgcgaggguagaauuaucaaggaaaucuucccuacagggaggguuaagcacaccgaggaauguacgugcggauuugcgaguaacaaaacuauugagugugccugccgggauaauucuuacacagcaaagcgcccauucgugaaacugaacgucgaaaccgacacugcugagauacgauuaaugugcacagagaccuaucuggauacgcccagaccuaaugacggcuccaucaccggcccaugugaaagcgauggggacaagggaucggguggcauuaaagggggauuugugcaucagaggauggccucuaagaucggccggugguacucccguacaaugucaaaaacuaagcgcauggguauggggcucuauguaaaguacgacggcgaucccuggaccgacagugaggcucuugcccugagcggaguuaugguguccauggaggaaccgggcugguacucuuucggguuugaaauaaaagauaagaaaugcgacgucccuuguauuggaaucgagauggugcacgaugguggcaagacaacuuggcauagcgcagccaccgcuaucuauugcuugauggggucaggacagcuacugugggacacagugaccggcgucgauauggcgcucuga

SEQ ID NO: 151813 - RNA, 1401 nt, Artificial Sequence; identical to SEQ ID NO: 151786
  derived and/or modified sequence opt3 from neuraminidase__InfluenzaB__AGX23802

SEQ ID NO: 151814 - RNA, 1401 nt, Artificial Sequence; identical to SEQ ID NO: 151786
  derived and/or modified sequence opt3 from neuraminidase__InfluenzaB__AGX23813

SEQ ID NO: 151815 - RNA, 1401 nt, Artificial Sequence; identical to SEQ ID NO: 151786
  derived and/or modified sequence opt3 from neuraminidase__InfluenzaB__AGX23824

SEQ ID NO: 151816 - RNA, 1401 nt, Artificial Sequence; identical to SEQ ID NO: 151786
  derived and/or modified sequence opt3 from neuraminidase__InfluenzaB__AGX23846

SEQ ID NO: 151817 - RNA, 1401 nt, Artificial Sequence; identical to SEQ ID NO: 150804
  derived and/or modified sequence opt3 from neuraminidase__InfluenzaB__AGX23857

SEQ ID NO: 151818 - RNA, 1401 nt, Artificial Sequence; identical to SEQ ID NO: 151786
  derived and/or modified sequence opt3 from neuraminidase__InfluenzaB__AGX23868

SEQ ID NO: 151819 - RNA, 1401 nt, Artificial Sequence
  derived and/or modified sequence opt3 from neuraminidase__InfluenzaB__AGX23879
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagacuuccauuuuccacauggccgcguggucaggcagugcaugccaugauggcaaagaauggaccuauaucgggguggacggaccggauagcaacgcccugcuuaagauuaaauacggugaggcuuacacagacacuuaucacucuuacgccaagaauauccugaggacccaagaauccgcauguaacugcauaggcggggauuguuauuugaugauuacagacggacccgcuucaggcguuagcgagugccgguuucucaaaauccgcgaggguagaauuaucaaggaaaucuucccuaccgggagggugaagcacacggaggaauguacuugcggauuugccaguaauaaaacaauugagugugcgugccgggauaacucuuacaccgccaagcgcccauucgucaaacugaauguggaaacugacacagcagagauacgauuaaugugcaccgagacguaucuggauacccccagaccuaacgacggcuccaucacaggcccaugugaaagcgauggggacaagggaucggguggcauuaaagggggauuuguacaucagaggauggcuucuaagaucggccggugguacucccguacuaugucaaaaaccaagcgcauggguauggggcucuauguuaaguacgacggcgaucccuggacagacagugaggcccuugcucugagcggagugauggucuccauggaggaaccgggcugguacucuuucggguuugaaauaaaagauaagaaaugcgacgugccuuguauuggaaucgagauggugcacgaugguggcaagacuaccuggcauagcgccgcaacagccaucuauugcuugauggggucaggacagcuacugugggacaccgucacuggcguugauauggcucucuga

SEQ ID NO: 151820 - RNA, 1401 nt, Artificial Sequence; identical to SEQ ID NO: 151786
  derived and/or modified sequence opt3 from neuraminidase__InfluenzaB__AGX23890

SEQ ID NO: 151821 - RNA, 1401 nt, Artificial Sequence; identical to SEQ ID NO: 150804
  derived and/or modified sequence opt3 from neuraminidase__InfluenzaB__AGX23901

SEQ ID NO: 151822 - RNA, 1401 nt, Artificial Sequence
  derived and/or modified sequence opt3 from neuraminidase__InfluenzaB__AGX23912
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauagacugaggcaucuaauaagcgugaaacucggaaagaucccaacggucgagaacuccauuuuccacauggccgcguggucaggcagugcaugccaugauggcaaggaauggacuuauguggggguugacggaccggauagcaaugcccugcuuaaaaucaaguacggugaggcuuacaccgacacauaucacucuuacgccaaaaacauucugcggacucaagaauccgcauguaauugcaucggcggggauuguuauuugaugauaaccgacggacccgcuucaggcauuagcgagugccgcuuucucaagaucagagaggguaggauuaucaaagaaaucuucccuacagggcgggugaagcacaccgaggaauguacgugcggauuugccaguaacaagacuauugagugugcgugccgcgauaauucuuacacagccaaacgaccauucgucaagcugaacguggaaaccgacacugcagagauaagauuaaugugcacagagaccuaucuggauacgcccaggccuaaugacggcuccaucaccggcccaugugggagcgauggagacaaagguucgggcgggauuaagggaggcuuuguacaucagcggauggcuucuaaaaucggucguugguacucccgcacaaugucaaagacuaaaagaauggggaugggccucuauguuaaguacgacggagaucccuggaccgacagugaagcccuugcucugagcggcgugauggucuccauggaugagccggggugguacucuuucggauuugaaauaaaggacaaaaagugcgaugugccuuguauugguaucgagauggugcacgacggcgggaaaacaacuuggcauagcgccgcaaccgccaucuauugcuugaugggaucaggccagcuacugugggauacagucaccgguguugacauggcucucuga

SEQ ID NO: 151823 - RNA, 1401 nt, Artificial Sequence; identical to SEQ ID NO: 150976
  derived and/or modified sequence opt3 from neuraminidase__InfluenzaB__AGX23934

SEQ ID NO: 151824 - RNA, 1401 nt, Artificial Sequence
  derived and/or modified sequence opt3 from neuraminidase__InfluenzaB__AGX23945
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgccaagaacauucugaggacucaagaauccgcauguaauugcaucggcggggauuguuauuugaugauaaccgacggacccgcuucaggcauuagcgagugccgguuucucaaaauccgcgaggguagaauuaucaaggaaaucuucccuacagggaggauuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugggagcgauggagacaaggguucgggcgggaucaaaggaggcuuugugcaucagaggauggcuucuaagauaggucggugguacucccguacaaugucaaaaacuaagcgcauggggaugggccucuauguaaaguacgacggagaucccuggaccgacagugaagcccuugcucugagcggcguuaugguguccauggaugagccggggugguacucuuucggauuugaaauuaaagacaagaaaugcgaugucccuuguaucgguaucgagauggugcacgacggcgggaagacaacuuggcauagcgccgcaaccgccauuuauugcuugaugggaucaggccagcuacugugggauacagugaccggugucgacauggcucucuga

SEQ ID NO: 151825 - RNA, 1401 nt, Artificial Sequence
  derived and/or modified sequence opt3 from neuraminidase__InfluenzaB__AGX23956
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggauugacggaccggauagcaaugcccugcuuaagaucaaauacggugaggcuuacaccgacacauaucacucuuacgccaagaacauacugaggacucaagaauccgcauguaauugcauuggcggggauuguuauuugaugaucaccgacggacccgcuucaggcgugagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugguguccauggaggaaccgggcugguacucuuucggguuugaaauuaaagauaagaaaugcgacgucccuuguaucggaaucgagauggugcacgaugguggcaagacaacuuggcauagcgccgcaaccgccauuuauugcuugauggggucaggacagcuacugugggacacagugaccggcgucgauauggcucucuga

SEQ ID NO: 151826 - RNA, 1401 nt, Artificial Sequence; identical to SEQ ID NO: 151163
  derived and/or modified sequence opt3 from neuraminidase__InfluenzaB__AGX23967

SEQ ID NO: 151827 - RNA, 1401 nt, Artificial Sequence; identical to SEQ ID NO: 150976
  derived and/or modified sequence opt3 from neuraminidase__InfluenzaB__AGX23978

SEQ ID NO: 151828 - RNA, 1401 nt, Artificial Sequence
  derived and/or modified sequence opt3 from neuraminidase__InfluenzaB__AGX23989
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaaucgcuacacagccaagcgaccauucgugaaacugaacgucgaaaccgacaaggcagagaucagauuaaugugcacugagacauaucuggauacccccaggccuaaugacggcucuauuacgggcccaugugaauccgauggggacaaaggaagcgguggcaucaaagggggauuugugcaucagcggauggcuucgaagauaggccguugguacucucgcaccauguccaagacaaagagaauggguauggggcucuauguaaaauacgacggcgaucccuggacugacucaggagcccuugcucugaguggcguuauggugagcauugaggaaccggggugguacuccuucggauuugagaucaaggauaaaaagugcgacgucccuuguaucgguauugaaauggugcacgauggcgggaaaaccacauggcauucugccgcaacugccaucuauugcuugaugggaagcggccagcuacugugggacaccgugacaggugucgauauggcucucuga

SEQ ID NO: 151829 - RNA, 1401 nt, Artificial Sequence; identical to SEQ ID NO: 151786
  derived and/or modified sequence opt3 from neuraminidase__InfluenzaB__AGX24000

SEQ ID NO: 151830 - RNA, 1401 nt, Artificial Sequence
  derived and/or modified sequence opt3 from neuraminidase__InfluenzaB__AGX24011
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauuaugcaaacgccucgaauguucaggcggugaaccacucagcugccaaaggaguaacucuccugcugccggaacccgaguggaccuacccuagacucagcugcccagguaguacauuccagaaggcauuacugauuucuccccauagguuuggcgaaaccaaaggcaauuccgccccucuuaucauucgggagccauucaucgcuuguggacccacugaaugcaagcacuuugcauugacacauuaugccgcucagccuggcgguuacuauaacgggacccgcgaggaccgaaauaaacugcgucaccuaauaagcgugaagcucggaaagaucccaacggucgagaacuccauuuuccauauggccgcguggucaggcagugcaugucacgauggcaaagaauggacuuacaucgggguggacggaccggauagcaaugcccugcuuaagauuaaauacggugaggcuuauaucgacaccuaccacucuuaugccaagaacauacugagaacacaagaauccgcaugcaauuguauuggcggggauugcuacuugaugaucacugacggacccgcuucaggcauuagcgaguguagguuucucaaaauccgggagggucgcaucauuaaggaaauauucccuaccgggagaguuaagcauacagaggaaugcaccuguggauuugccaguaacaaaacgaucgagugcgcguguagggauaauucuuauacugccaagcggccauucgugaaacugaacgucgaaacagacaccgcagagauucgcuuaaugugcacugagacauaccuggauacgccccgaccuaaugacggcuccaucaccggcccaugcgaaagcgauggggacaagggaucggguggcauaaaagggggauuugugcaccagagaauggcuucuaagauugggaggugguauucccggaccaugucaaaaacaaagcguauggguauggggcucuacguaaaguacgacggcgaucccuggacugacagugaggcccuugcucugagcggaguuaugguguccauggaggaaccgggcugguauucuuucggguuugaaaucaaagauaagaaaugugacgucccuugcaucggaauugagauggugcaugaugguggcaagaccacauggcacagcgccgcaacugccaucuacuguuugauggggucaggacagcuacugugggacaccgugacaggcgucgauauggcucucuga

SEQ ID NO: 151831 - RNA, 1401 nt, Artificial Sequence; identical to SEQ ID NO: 150976
  derived and/or modified sequence opt3 from neuraminidase__InfluenzaB__AGX24022

SEQ ID NO: 151832 - RNA, 1401 nt, Artificial Sequence
  derived and/or modified sequence opt3 from neuraminidase__InfluenzaB__AGX24033
augcugcccagcaccauccagacacucacucuuuuccugacguccggcgggguguuguuaucucuguacgucucagccagucuaagcuaucuccuguacuccgacauucuucugaaguuuucucaaaccgagauaacagcucagaucaugccuuuggauugcgcaaacgccucgaauguucaggcggugaacagaucagcugccaaaggaguaacucuccugcugccagaaccggaguggaccuaucccaggcucagcuguccugguaguacauuccagaaggcauuacugauuuccccacaccgguuuggcgaaaccaaaggaaauucugcuccccuuaucauucgcgagccuuucaucgccugcgggccaacugaauguaagcauuuugcauugacacacuacgccgcucaacccggcgguuauuacaacgggacccgagaggaccguaauaaacugagacaucuaauaagcgugaagcucggaaagaucccuacggucgagaacuccauuuuccacauggccgcguggucaggcagugcaugccaugauggcaaagaauggacuuauaucgggguggacggaccagauagcaaugcccugcuuaagauuaaauacggugaggcuuacaccgacacauaucacucuuacgccaagaacauccugaggacucaggaauccgcauguaauugcauaggcggggauuguuauuugaugauuaccgacggaccggcuucaggcaucagcgagugccgguuucucaaaauucgcgaggguagaaucaucaaggaaauuuuccccacagggaggguuaagcacaccgaggaauguacgugcggauuugccaguaacaaaacuauagagugugcgugccgggauaaucgcuacacagccaagcgaccuuucgugaaacugaacgucgaaaccgacaaggcagagaucagauuaaugugcacugagacauaucuggauaccccaaggcccaaugacggcucuauuacgggcccuugugaauccgauggggacaaaggaagcgguggcaucaaagggggauuugugcaucagcggauggcuucgaagauaggccguugguacucucgcaccauguccaagacaaagagaauggguauggggcucuauguaaaauacgacggcgauccauggacugacucaggagcccuugcucugaguggcguuauggugagcauugaggaacccgggugguacuccuucggauuugagaucaaggauaaaaagugcgacgucccguguaucgguauugaaauggugcacgauggcgggaaaaccacauggcauucugccgcaacugccaucuauugcuugaugggaagcggccagcuacugugggacaccgugacaggugucgauauggcucucuga

SEQ ID NO: 151833 - RNA, 1401 nt, Artificial Sequence; identical to SEQ ID NO: 150976
  derived and/or modified sequence opt3 from neuraminidase__InfluenzaB__AGX24044

SEQ ID NO: 151834 - RNA, 1401 nt, Artificial Sequence
  derived and/or modified sequence opt3 from neuraminidase__InfluenzaB__AGX24055
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaacccuccugcugccggaacucgaguggacauaucccagguuaagcuguccugguaguaccuuccagaaggcccugcuuauuuccccacaccgguuuggcgaaacuaaaggaaauucugcacccuugaucauucgcgagccuuucguggccugcgggccaacagaauguaagcauuuugcucugacccacuacgcagcccagcccggcgguuauuacaacgggacgcgagaggaccguaauaaacuaagacaucucaucagcgucaagcugggaaagauaccuacuguggagaacuccaucuuccacauggcugccuggucaggcagugcgugccaugauggcaaagaauggaccuauauugggguugacggaccaaauagcaacgcacuucugaagaucaaauacggugaggccuacacagauacuuaucacucuuacgcuaagaauauuuugaggacccaagaauccgccuguaacugcaucggcggggacuguuaucucaugauaacagauggaccggcaucaggcgugagcgagugccgguuucugaaaauucgcgaggguagaaucauuaaggaaaucuuccccaccgggagggucaagcacacggaggaauguacuugcggauuugcuaguaauaaaacaaucgagugugccugccgggacaacucuuacaccgcgaagcgcccuuucgugaaauuaaauguagaaacugauacagccgagauucgacugaugugcaccgagacguaucucgacaccccaagacccaacgauggcuccauaacaggcccuugugaaagcgacggggauaagggaucggguggcaucaaagggggauuuguucaucagaggauggcaucuaagauuggccggugguacucccguacuaugucaaaaaccaagcgcauggguauggggcuuuaugugaaguacgacggcgacccauggacagauagugaggcucuggccuugagcggagucaugguguccauggaggaacccggcugguacucuuucggguuugaaaucaaagacaagaaaugcgaugugccguguauaggaauugagaugguccacgacgguggcaagacuaccuggcauagcgcugccacagcaaucuauugccuaauggggucaggacagcugcucugggauaccguuacuggcguggacauggcccuguga

SEQ ID NO: 151835 - RNA, 1401 nt, Artificial Sequence; identical to SEQ ID NO: 150833
  derived and/or modified sequence opt3 from neuraminidase__InfluenzaB__AGX24066

SEQ ID NO: 151836 - RNA, 1401 nt, Artificial Sequence
  derived and/or modified sequence opt3 from neuraminidase__InfluenzaB__AGX24077
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcgggaacuguuauuugaugauuaccgauggacccgcuucaggcaucagcgagugccgguuucucaaaauucgcgaggguagaaucaucaaggaaauuuucccuacagggaggguuaagcacaccgaggaauguacgugcggauuugccaguaauaaaacuauagagugugcgugccgggacaaccgcuacacagccaagcgaccauucgugaaacugaaugucgaaaccgauaaggcagagaucagauuaaugugcacugagacauaucuggacacccccaggccuaacgauggcucuauuacgggcccaugugaauccgacggggauaaaggaagcgguggcaucaaagggggauuugugcaucagcggauggcuucgaagauaggccguugguacucucgcaccauguccaagacaaagagaauggguauggggcucuauguaaaauacgacggcgaccccugggccgauucaggagcucuugcccugaguggcguuauggugagcauugaggaaccggggugguacuccuucggauuugagaucaaggacaaaaagugcgaugucccuuguaucgguauugaaauggugcacgacggcgggaaaacuaccuggcauucugcagccacagcuaucuauugcuugaugggaagcggccagcuacugugggauacugugaccggugucgacauggcgcucuga

SEQ ID NO: 151837 - RNA, 1401 nt, Artificial Sequence
  derived and/or modified sequence opt3 from neuraminidase__InfluenzaB__AGX24088
augcugcccagcaccauccagacacucacucuuuucauuacguccggcggggugcuguugucuuuauacgucucagccagucugagcuaucuacucuacuccgacauacugcuuaaguuuucucaaaccgagaucacagcuccuauuaugccacuggauugcgcaaacgccucgaauguucaggcggugaacagaucagcugccaaaggaguaacuuugcuccugccggaacccgaguggaccuauccuaggcugagcuguccagguaguacauuccagaaggcacucuuaaucucuccccaccgguuuggcgaaaccaaaggaaauuccgccccucugauuauccgcgagccauucauagcuugcgggcccacugaauguaagcauuuugcacuuacacacuacgccgcucagccuggcgguuauuacaacgggacccgagaggaccguaauaaauugagacaucugaucagcgugaagcuaggaaagauuccaacggucgagaacuccaucuuccacauggccgcguggucaggcagugcaugccaugauggcaaagaauggacuuauguggggguugacggaccggauagcgacgcccuccugaagauuaaauacggugaggcuuacaccgauacauaucacucuuacgccaagaauauccuuaggacucaagaauccgcauguaacugcauaggcggggacuguuaucugaugauuaccgauggacccgcuucaggcaucagcgagugccgguuuuugaaaauucgcgaggguagaaucaucaaggaaauuuucccuacagggagggugaagcacaccgaggaauguacgugcggauuugccaguaauaaaacuauagagugugcgugccgggacaacucuuacacagccaagcgcccauucgucaaacucaauguggaaaccgauacugcagagauccgacugaugugcacagagaccuauuuagacacgcccagaccuaacgauggcuccauuaccggcccaugugggagcgacggagacaaggguucgggcgggaucaaaggaggcuuuguacaucagaggauggcuucuaagauaggucggugguacucccguacaaugucaaaaacuaagcgcauggggaugggccuguauguuaaguacgauggagaccccuggaccgauagugaagcccucgcucuuagcggcgugauggucuccauggacgagccggggugguacucuuucggauuugaaauuaaagauaagaaaugcgacgugccuuguaucgguaucgagauggugcacgauggcgggaagacaacuuggcauagcgccgcaaccgccauuuauugccugaugggaucaggccaguugcuaugggacacagucaccgguguugauauggcucuguga

SEQ ID NO: 151838 - RNA, 1401 nt, Artificial Sequence; identical to SEQ ID NO: 150976
  derived and/or modified sequence opt3 from neuraminidase__InfluenzaB__AGX24099

SEQ ID NO: 151839 - RNA, 1401 nt, Artificial Sequence
  derived and/or modified sequence opt3 from neuraminidase__InfluenzaB__AGX24110
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauguggggguugacggaccggauagcaaugcccugcuuaagaucaaauacggugaggcuuacaccgacacauaucacucuuacgccaagaacauucugaggacucaagaauccgcauguaauugcaucggcggggauuguuauuugaugauaaccgacggacccgcuucaggcauuagcgagugccgguuucucaaaauccgcgaggguagaauuaucaaggaaaucuucccuacagggagggugaagcacaccgaggaauguacgugcggauuugccaguaacaaaacuauugaguguacaugccgggauaauucuuacaccgcgaagcgcccauucgucaaacugaacguggaaacugacacagccgagauacgauuaaugugcaccgagacguaucuggauacccccagaccuaaugacggcuccaucacaggcccaugugggagcgauggagacaaggguucgggcgggauuaaaggaggcuuuguacaucagaggauggcaucuaagaucggucggugguacucccguacuaugucaaaaaccaagcgcauggggaugggccucuauguuaaguacgacggagaucccuggacagacagugaagcucuugcccugagcggcgugauggucuccauggaugagccggggugguacucuuucggauuugaaauaaaagacaagaaaugcgaugugccuuguauugguaucgagauggugcacgacggcgggaagacuaccuggcauagcgcugccacagcaaucuauugcuugaugggaucaggccagcuacugugggauaccgucacugguguugacauggcccucuga

SEQ ID NO: 151840 - RNA, 1401 nt, Artificial Sequence
  derived and/or modified sequence opt3 from neuraminidase__InfluenzaB__AGX24121
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauuaugcaaacgccucgaauguucaggcggugaaccacucagcugccaaaggaguaacucuccugcugccggaacccgaguggaccuacccuagacucagcugcccagguaguacauuccagaaggcauuacugauuucuccccauagguuuggcgaaaccaaaggcaauuccgccccucuuaucauucgggagccauucaucgcuuguggacccacugaaugcaagcacuuugcauugacacauuaugccgcuaaaccuggcgguuacuauaacgggacccgcgaggaccgaaauaagcugcgucaccuaauaagcgugaagcucggaaaaaucccaacggucgagaacuccauuuuccauauggccgcguggucaggcagugcaugucacgauggcaaggaauggacuuacaucgggguggacggaccggauagcaaugcccugcuuaaaauuaaguacggugaggcuuauaccgacacauaccacucuuaugccaaaaacauccugagaacucaggaauccgcaugcaauuguauaggcggggauugcuacuugaugauuaccgacggacccgcuucaggcaucagcgaguguagguuucucaagauucgggagggucgcaucaucaaggaaauuuucccuacagggagaguuaaacauaccgaggaaugcacguguggauuugccaguaacaagacuauagagugcgcguguagggauaauucuuauacagccaaacggccauucgugaagcugaacgucgaaaccgacacugcagagauccgcuuaaugugcacagagaccuaccuggauacgccccgaccuaaugacggcuccauuaccggcccaugcgaaagcgauggggacaaaggaucggguggcaucaaagggggauuugugcaccaaagaauggcuucuaagauagggaggugguauucccggacaaugucaaagacuaagcguauggguauggggcucuacguaaaauacgacggcgaucccuggaccgacagugaggcccuugcucugagcggaguuaugguguccauggaggaaccgggcugguauucuuucggguuugaaauuaaggauaaaaagugugacgucccuugcaucggaaucgagauggugcaugaugguggcaaaacaacuuggcacagcgccgcaaccgccauuuacuguuugauggggucaggacagcuacugugggacacagugaccggcgucgauauggcucucuga

SEQ ID NO: 151841 - RNA, 1401 nt, Artificial Sequence
  derived and/or modified sequence opt3 from neuraminidase__InfluenzaB__AGX24132
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccucccgcugcccgaaccugaguggacauauccacggcugagcugucccgguaguaccuuccagaaggcccucuuaauuuccccucaccgcuuuggcgaaacuaaaggaaauucugcaccacugaucauucgagagcccuucaucgccugcgggccuaaggaauguaaacauuuugcucuuacacacuacgcagcccagccaggcgguuauuacaacgggacccgugaggacagaaauaaguugaggcaucugauaagcgugaagcuaggaaaaaucccgacggucgagaacuccauuuuccacauggcugccuggucaggcagugcgugccaugauggccgggaauggacuuauaucgggguggacggacccgauagcaaugcacuccugaagauuaaauacggugaggccuacaccgacacauaucacucuuacgcuaagaacauccuucgcacucaggaauccgccuguaauugcauaggcggggauuguuaucugaugauuaccgacggaccugcauugggcaucucagagugcagauuucucaaaauuagggagggucggaucaucaaggaaauuuucccaacagggcgcguuaagcacaccgaggaauguacgugcggauuugcuagcaacaaaacuauagagugugccugccgagauaauaguuacacagcgaagagacccuucgugaaacugaacgucgaaaccgacacugccgagaucagguuaaugugcacagagaccuaucuggauacgccucggccaaaugacggcucuauuaccggccccugugaauccaacggggauaagggaagcgguggcaucaaagggggauuugugcaucaacguauggcaucgaagauaggccgcugguacucuagaacaauguccaaaacuaagaggauggguauggggcucuauguaaaguacgacggcgacccguggaccgauucagaggcucuugcccugaguggaguuauggugagcauggaggaaccuggcugguacuccuucggguuugaaauuaaagacaagaaaugcgauguccccuguaucggaaucgagauggugcacgacgguggcaagacaacuuggcauucugcugccaccgcaauuuauugcuugauggggagcggacagcuacugugggauacagugaccggcgucaauaugacucucuga

SEQ ID NO: 151842 - RNA, 1401 nt, Artificial Sequence
  derived and/or modified sequence opt3 from neuraminidase__InfluenzaB__AGX24143
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggaugguaaugcccugcuuaagauuaaauacggcgaggcuuacaccgacacauaucacagcuacgccaagaacauccugaggacucaagaaucugcauguaauugcauagggggagauuguuauuugaugauuaccgacggccccgcuuccgguaucucagagugccgguuucucaaaauucgcgaggggagaaucaucaaggaaauuuucccuacaggaaggguuaagcacaccgaggaauguacgugcggcuuugccagcaacaaaacuauagagugugcgugccgggauaauaguuacacagccaagcgcccauucgugaaacugaacgucgaaaccgacacugcagagauccgauuaaugugcacagagaccuaucuggauacgcccagaccuaaugacggcucuauuaccgggccaugugaauccgauggagacaaggguagcggcgggaucaaaggaggcuuugugcaucagaggauggcuucgaagauaggucggugguacucucguacaauguccaaaacuaagcgcauggggaugggccucuauguaaaguacgacggagaucccuggaccgacucagaggcccuugcucugaguggcguuauggugagcauggaggaaccggggugguacuccuucggauuugaaauuaaagauaagaaaugcgacgucccuuguaucgguaucgagauggugcacgauggcgggaagacaacuuggcauucugccgcaaccgccauuuauugcuugaugggaagcggccagcuacugugggacacagugaccggugucgauauggcucucuga

SEQ ID NO: 151843 - RNA, 1401 nt, Artificial Sequence; identical to SEQ ID NO: 150976
  derived and/or modified sequence opt3 from neuraminidase__InfluenzaB__AGX24154

SEQ ID NO: 151844 - RNA, 1401 nt, Artificial Sequence
  derived and/or modified sequence opt3 from neuraminidase__InfluenzaB__AGX24165
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauuaugcaaacgccucgaauguucaggcggugaaccacucagcugccaaaggaguaacucuccugcugccggaacccgaguggaccuacccuagacucagcugcccagguaguacauuccagaaggcauuacugauuucuccccauagguuuggcgaaaccaaaggcaauuccgccccucuuaucauucgggagccauucaucgcuuguggacccacugaaugcaagcacuuugcauugacacauuaugccgcucagccuggcgguuacuauaacgggacccgcgaggaccgaaauaaacugcgucaccuaauaagcgugaagcucggaaagaucccaacggucgagaacuccauuuuccauauggccgcguggucaggcagugcaugucacgauggcaaagaauggacuuacaucgggguggacggaccggauagcaaugcccugcuuaagauuaaauacggugaggcuuauaccgacacauaccacucuuaugccaagaacauccugagaacucaagaauccgcaugcaauuguauaggcggggauugcuacuugaugauuaccgacggacccgcuucaggcaucagcgaguguagguuucucaaaauucgggagggucgcaucaucaaggaaauuuucccuacagggagaguuaagcauaccgaggaaugcacguguggauuugccaguaacaaaacuauagagugcgcguguagggauaauucuuauacagccaagcggccauucgugaaacugaacgucgaaaccgacacugcagagauccgcuuaaugugcacagagaccuaccuggauacgccccgaccuaaugacggcuccauuaccggcccaugcgaaagcgauggggacaagggaucggguggcaucaaagggggauuugugcaccagagaauggcuucuaagauagggaggugguauucccggacaaugucaaaaacuaagcguauggguauggggcucuacguaaaguacgacggcgaucccuggaccgacagugaggcccuugcucugaacggaguuauggugagcauggaggaaccgggcugguauuccuucggguuugaaauuaaagauaagaaaugugacgucccuugcaucggaaucgagauggugcaugaugguggcaagacaacuuggcacucugccgcaaccgccauuuacuguuugauggggagcggacagcuacugugggacacagugaccggcgucgauauggcucucuga

SEQ ID NO: 151845 - RNA, 1401 nt, Artificial Sequence; identical to SEQ ID NO: 150833
  derived and/or modified sequence opt3 from neuraminidase__InfluenzaB__AGX24176

SEQ ID NO: 151846 - RNA, 1401 nt, Artificial Sequence; identical to SEQ ID NO: 150833
  derived and/or modified sequence opt3 from neuraminidase__InfluenzaB__AGX24187

SEQ ID NO: 151847 - RNA, 1401 nt, Artificial Sequence; identical to SEQ ID NO: 150833
  derived and/or modified sequence opt3 from neuraminidase__InfluenzaB__AGX24198

SEQ ID NO: 151848 - RNA, 1401 nt, Artificial Sequence; identical to SEQ ID NO: 151163
  derived and/or modified sequence opt3 from neuraminidase__InfluenzaB__AGX24231

SEQ ID NO: 151849 - RNA, 1401 nt, Artificial Sequence; identical to SEQ ID NO: 150833
  derived and/or modified sequence opt3 from neuraminidase__InfluenzaB__AGX24242

SEQ ID NO: 151850 - RNA, 1401 nt, Artificial Sequence
  derived and/or modified sequence opt3 from neuraminidase__InfluenzaB__AGX24275
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaaccggacuauagagugugcgugccgcgauaauucuuacacagccaaacgaccauucgugaagcugaacgucgaaaccgacacugcagagaucagauuaaugugcacagagaccuaucuggauacgcccaggccuaaugacggcuccauuaccggcccaugugaaagcgauggggacaaaggaucggguggcaucaaagggggauuugugcaucagcggauggcuucuaagauaggccguugguacucccgcacaaugucaaagacuagaaggauggguauggggcucuauguaaaauacgacggcgaucccuggaccgacagugaggcccuugcucugagcggaguuaugguguccauggaggaaccgggcugguacucuuucggguuugaaauuaaggauaagaaaugcgacgucccuuguaucggaaucgagauggugcacgaugguggcaagacaacuuggcauagcgccgcaaccgccauuuauugcuugauggggucaggacagcuacugugggacacagugaccggcgucgauauggcucucuga

SEQ ID NO: 151851 - RNA, 1401 nt, Artificial Sequence; identical to SEQ ID NO: 151428
  derived and/or modified sequence opt3 from neuraminidase__InfluenzaB__AGX24286

SEQ ID NO: 151852 - RNA, 1401 nt, Artificial Sequence
  derived and/or modified sequence opt3 from neuraminidase__InfluenzaB__AGX24297
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaacccgcggaaauuccgccccucuuaucauucgagagccauucaucgcuugcgggcccacugaauguaaacauuuugcauugacacacuacgccgcucagccuggcgguuauuacaacgggacccgugaggacagaaauaagcugaggcaucuaauaagcgugaaacucggaaagaucccaacggucgagaacuccauuuuccacauggccgcguggucaggcagugcaugccaugauggcaaggaauggacuuauaucgggguggacggaccggauagcaaugcccugcuuaaaauuaaguacggugaggcuuacaccgacacauaucacucuuacgccaaaaacauccugcggacucaagaauccgcauguaauugcauaggcggggauuguuauuugaugauuaccgacggacccgcuucaggcaucagcgagugccgcuuucucaagauuagagaggguaggaucaucaaagaaauuuucccuacagggcggguuaagcacaccgaggaauguacgugcggauuugccaguaacaagacuauagagugugcgugccgcgauaauucuuacacagccaaacgaccauucgugaagcugaacgucgaaaccgacacugcagagaucagauuaaugugcacagagaccuaucuggauacgcccaggccuaaugacggcuccauuaccggcccaugugaaagcgauggggacaaaggaucggguggcaucaaagggggauuugugcaucagcggauggcuucuaagauaggccguugguacucccgcacaaugucaaagacuaaaagaauggguauggggcucuauguaaaguacgacggcgaucccuggaccgacagugaggcccuugcucugagcggaguuaugguguccauggaggaaccgggcugguacucuuucggguuugaaauuaaggauaaaaagugcgacgucccuuguaucggaaucgagauggugcacgaugguggcaaaacaacuuggcauagcgccgcaaccgccauuuauugcuugauggggucaggacagcuacugugggacacagugaccggcgucgauauggcucucuga

SEQ ID NO: 151853 - RNA, 1401 nt, Artificial Sequence; identical to SEQ ID NO: 151428
  derived and/or modified sequence opt3 from neuraminidase__InfluenzaB__AGX24319

SEQ ID NO: 151854 - RNA, 1401 nt, Artificial Sequence
  derived and/or modified sequence opt3 from neuraminidase__InfluenzaB__AGX24330
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauuaugcaaacgccucgaauguucaggcggugaaccacucagcugccaaaggaguaacucuccugcugccggaacccgaguggaccuacccuagacucagcugcccagguaguacauuccagaaggcauuacugauuucuccccauagguuuggcgaaaccaaaggcaauuccgccccucuuaucauucgggagccauucaucgcuuguggacccacugaaugcaagcacuuugcauugacacauuaugccgcucagccuggcgguuacuauaacgggacccgcgaggaccgaaauaaacugcgucaccuaauaagcgugaagcucggaaagaucccaacggucgagaacuccauuuuccauauggccgcguggucaggcagugcaugucacgauggcaaagaauggacuuacaucgggguggacggaccggauagcaaugcccugcuuaagauuaaauacggugaggcuuauaccgacacauaccacucuuaugccaagaacauccugagaacucaagaauccgcaugcaauuguauaggcggggauugcuacuugaugauuaccgacggacccgcuucaggcaucagcgaguguagguuucucaaaauucgggagggucgcaucaucaaggaaauuuucccuacagggagaguuaagcauaccgaggaaugcacguguggauuugccaguaacaaaacuauagagugcacauguagggauaauucuuauaccgcgaagcggccauucgugaaacugaacgucgaaacugacacagccgagauccgcuuaaugugcaccgagacguaccuggauacaccccgaccuaaugacggcuccauuaccggcccaugcgaaagcgauggggacaagggaucggguggcaucaaagggggauuugugcaccagagaauggcaucuaagauagggaggugguauucccggacuaugucaaaaaccaagcguauggguauggggcucuacguaaaguacgacggcgaucccuggacagacagugaggcucuugcccugagcggaguuaugauuuccauggaggaaccgggcugguauucuuucggguuugaaaucaaagauaagaaaugugacgugccuugcaucggaauugagaugguccaugaugguggcaagacuaccugguacagcgcugccacagcaaucuauuguuugauggggucaggacagcuacugugggacaccgugacuggcguggauauggcccucuga

SEQ ID NO: 151855 - RNA, 1401 nt, Artificial Sequence
  derived and/or modified sequence opt3 from neuraminidase__InfluenzaB__AGX24341
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcaacggggauaagggaucggguggcaucaaagggggauuugugcaucaacguauggcaucuaagauaggccgcugguacuccagaacaaugucaaaaacuaagaggauggguauggggcucuauguaaaguacgacggcgaccccuggaccgauagugaggcucuuacacugagcggaguuaugguguccauggaggaaccgggcugguacucuuucggguuugaaauuaaagacaagaaaugcgaugucccuuguaucggaaucgagauggugcacgacgguggcaagacuaccuggcauagcgccgcuacagccauuuauugcuugauggggucaggacagcuacugugggauaccgugacuggcgucaauaugacgcucuga

SEQ ID NO: 151856 - RNA, 1401 nt, Artificial Sequence
  derived and/or modified sequence opt3 from neuraminidase__InfluenzaB__AGX24352
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauaauaacgcacugcuuaagauuaaauacggugaggccuacaccgacacauaucacagcuacgcuaagaauauccugcgcacucaggaaucugccuguaacugcauaggcggggauuguuauuugaugauuaccgacggacccgcauccggcaucucagagugcagauuucucaaaauuagggagggucggaucaucaaggaaauuuucccuacagggcgcguuaagcacaccgaggaauguacgugcggauuugcuagcaauaaaacuauagagugugccugccgagauaacaguuacacagcgaagagaccauucgugaaacugaaugucgaaaccgacacugccgagaucagguuaaugugcacagagaccuaucuggauacgccccggccuaacgacggcucuauuaccggcccaugugaauccaauggggauaagggaagcgguggcaucaaagggggauuugugcaucaacguauggcaucgaagauaggccgcugguacucuagaacaauguccaaaacuaagaggauggguauggggcucuauguaaaguacgacggcgaccccuggaccgauucagaggcucuugcccugaguggaguuauggugagcauggaggaaccgggcugguacuccuucggguuugaaauuaaagacaagaaaugcgaugucccuuguaucggaaucgagauggugcacgacgguggcaagacaacuuggcauucugcugccaccgcaauuuauugcuugauggggagcggacagcuacugugggauacagugaccggcgucaacaugacucucuga

SEQ ID NO: 151857 - RNA, 1401 nt, Artificial Sequence; identical to SEQ ID NO: 151852
  derived and/or modified sequence opt3 from neuraminidase__InfluenzaB__AGX24363

SEQ ID NO: 151858 - RNA, 1401 nt, Artificial Sequence; identical to SEQ ID NO: 151856
  derived and/or modified sequence opt3 from neuraminidase__InfluenzaB__AGX24374

SEQ ID NO: 151859 - RNA, 1401 nt, Artificial Sequence
  derived and/or modified sequence opt3 from neuraminidase__InfluenzaB__AGX24385
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuacuaugccauuggauugcgcaaacgccucgaauguucaagcggugaacaggucagcuaccaaaggaguaacacuccugcugccggaacccgaguggaccuauccucggcucagcuguccagguaguacuuuccagaaggccuuacugaucucuccccaccgcuuuggcgaaacaaaaggaaauuccgcaccucuuauuauccgagagccauucauugccugcgggcccaaggaauguaaacauuuugcuuugacccacuacgcagcccagccuggcgguuauuacaacgggacgcgugaggacagaaauaagcugaggcaucuaaucagcgugaagcucggaaaaauaccaacugucgagaacuccaucuuccacauggcugccuggucaggcagugcgugccaugauggccgggaauggaccuauauugggguggacggaccggauagcaaugcacugcuuaagaucaaauacggugaggccuacacagacacuuaucacucuuacgcuaagaacauucugcgcacccaggaauccgccuguaauugcaucggcggggauuguuauuugaugauaacagacggacccgcaucaggcauuagcgagugcagauuucucaaaaucagggagggucggauuaucaaggaaaucuucccuaccgggcgcguuaagcacacggaggaauguacuugcggauuugcuaguaacaaaacaauugagugugccugccgagauaauucuuacaccgcgaagagaccauucgugaaacugaacgucgaaacugacacagccgagauaagguuaaugugcaccgagacguaucuggauacaccccggccuaaugacggcuccaucaccggcccaugugaaagcaacggggauaagggaucggguggcauuaaagggggauuugugcaucaacguauggcaucuaagaucggccgcugguacuccagaacuaugucaaaaaccaagaggauggguauggggcucuauguaaaguacgacggcgaccccuggacagauagugaggcucuugcccugagcggaguuaugguguccauggaggaaccgggcugguacucuuucggguuugaaauaaaagacaagaaaugcgaugucccuuguauuggaaucgagauggugcacgacgguggcaagacuaccuggcauagcgcugccacagcaaucuauugcuugauggggucaggacagcuacugugggauaccgugacuggcgucaauaugacgcucuga

SEQ ID NO: 151860 - RNA, 1401 nt, Artificial Sequence
  derived and/or modified sequence opt3 from neuraminidase__InfluenzaB__AGX24396
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaaucgcuacacagccaagcgaccauucgugaaacugaacgucgaaaccgacacugcagagaucagauuaaugugcacagagaccuaucuggauacgcccaggccuaaugacggcucuauuaccggcccaugugaauccgauggggacaagggaagcgguggcaucaaagggggauuugugcaucagcggauggcuucgaagauaggccguugguacucucgcacaauguccaaaacuaagagaauggguauggggcucuauguaaaguacgacggcgaucccuggaccgacucaggagcccuugcucugaguggcguuauggugagcauugaggaaccggggugguacuccuucggauuugagaucaaagauaagaaaugcgacgucccuuguaucgguauugaaauggugcacgauggcgggaagacaacuuggcauucugccgcaaccgccaucuauugcuugaugggaagcggccagcuacugugggacacagugaccggugucgauauggcucucuga

SEQ ID NO: 151861 - RNA, 1401 nt, Artificial Sequence; identical to SEQ ID NO: 151860
  derived and/or modified sequence opt3 from neuraminidase__InfluenzaB__AGX24407

SEQ ID NO: 151862 - RNA, 1401 nt, Artificial Sequence; identical to SEQ ID NO: 150833
  derived and/or modified sequence opt3 from neuraminidase__InfluenzaB__AGX24418

SEQ ID NO: 151863 - RNA, 1401 nt, Artificial Sequence; identical to SEQ ID NO: 150804
  derived and/or modified sequence opt3 from neuraminidase__InfluenzaB__AGX24429

SEQ ID NO: 151864 - RNA, 1401 nt, Artificial Sequence
  derived and/or modified sequence opt3 from neuraminidase__InfluenzaB__AGX24440
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggacuacagaauguaagcauuuugcauugacccacuacgccgcucagcccggcgguuauuacaacgggacgcgagaggaccguaauaaacugagacaucuaauaagcgugaagcucggaaagaucccuacugucgagaacuccauuuuccacauggccgcguggucaggcagugcaugccaugauggcaaagaauggaccuauaucgggguggacggaccagauagcaaugcccugcuuaagauuaaauacggugaggcuuacacagacacuuaucacucuuacgccaagaacauccugaggacccaagaauccgcauguaauugcauaggcggggauuguuauuugaugauuacagacggaccggcuucaggcaucagcgagugccgguuucucaaaauucgcgaggguagaaucaucaaggaaauuuuccccaccgggaggguuaagcacacggaggaauguacuugcggauuugccaguaacaaaacaauagagugugcgugccgggauaaucgcuacaccgccaagcgaccuuucgugaaacugaacgucgaaacugacacagcagagaucagauuaaugugcaccgagacguaucuggauaccccaaggcccaaugacggcucuauuacaggcccuugugaauccgauggggacaagggaagcgguggcaucaaagggggauuugugcaucagcggauggcuucgaagauaggccguugguacucucgcacuauguccaaaaccaagagaauggguauggggcucuauguaaaguacgacggcgauccauggacagacucaggagcccuugcucugaguggcguuauggugagcauugaggaacccgggugguacuccuucggauuugagaucaaagauaagaaaugcgacgucccguguaucgguauugaaauggugcacgauggcgggaagacuaccuggcauucugccgcaacaaccaucuauugcuugaugggaagcggccagcuacugugggacacugugacgggugucgauauggcccucuga

SEQ ID NO: 151865 - RNA, 1401 nt, Artificial Sequence; identical to SEQ ID NO: 151428
  derived and/or modified sequence opt3 from neuraminidase__InfluenzaB__AGX24451

SEQ ID NO: 151866 - RNA, 1401 nt, Artificial Sequence
  derived and/or modified sequence opt3 from neuraminidase__InfluenzaB__AGX24462
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauuaugcaaacgccucgaauguucaggcggugaaccacucagcugccaaaggaguaacucuccugcugccggaacccgaguggaccuacccuagacucagcugcccagguaguacauuccagaaggcauuacugauuucuccccauagguuuggcgaaaccaaaggcaauuccgccccucuuaucauucgggagccauucaucgcuuguggacccacugaaugcaagcacuuugcauugacacauuaugccgcucagccuggcgguuacuauaacgggacccgcgaggaccgaaauaaacugcgucaccuaauaagcgugaagcucggaaagaucccaacggucgagaacuccauuuuccauauggccgcguggucaggcagugcaugucacgauggcaaagaauggacuuacaucgggguggacggaccggauagcaaugcccugcuuaagauuaaauacggugaggcuuauaccgacacauaccacucuuaugccaagaacauccugagaacucaagaauccgcaugcaauuguauaggcggggauugcuacuugaugauuaccgacggacccgcuucaggcaucagcgaguguagguuucucaaaauucgggagggucgcaucaucaaggaaauuuucccuacagggagaguuaagcauaccgaggaaugcacguguggauuugccaguaacaaaacuauagagugcgcguguagggauaauucuuauacagccaagcggccauucgugaaacugaacgucgaaaccgacacugcagagauccgcuuaaugugcacagagaccuaccuggauacgccccgaccuaaugacggcuccauuaccggcccaugcgaaagcgauggggacaagggaucggguggcaucaaagggggauuugugcaccagagaauggcuucuaagauagggaggugguauucccggacaaugucaaaaacuaagcguauggguauggggcucuacguaaaguacgacggcgaucccuggaccgacagugaggcccuugcucugagcggaguuaugauuuccauggaggaaccgggcugguauucuuucggguuugaaaucaaagauaagaaaugugacgugccuugcaucggaauugagaugguccaugaugguggcaagacaacuuggcacagcgccgcaaccgccaucuacuguuugauggggucaggacagcuacugugggacacagugaccggcguggauauggcucucuga

SEQ ID NO: 151867 - RNA, 1401 nt, Artificial Sequence; identical to SEQ ID NO: 151866
  derived and/or modified sequence opt3 from neuraminidase__InfluenzaB__AGX24473

SEQ ID NO: 151868 - RNA, 1401 nt, Artificial Sequence
  derived and/or modified sequence opt3 from neuraminidase__InfluenzaB__AGX24484
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauggcuacacagccaagcgcccauucgugaaacugaacgucgaaaccgacacugcagagauccgauuaaugugcacagagaccuaucuggauacgcccagaccuaaugacggcucuauuaccgggccaugugaauccgauggagacaaggguagcggcgggaucaaaggaggcuuugugcaucagaggauggcuucgaagauaggucggugguacucucguacaauguccaaaacucgcagaauggggaugggccucuauguaaaguacgacggagaucccuggaccgacucagaggcccuugcucugaguggcguuauggugagcauggaggaaccggggugguacuccuucggauuugaaauuaaggauaaaaagugcgacgucccuuguaucgguaucgagauggugcacgauggcgggaaaacaacuuggcauucugccgcaaccgccauuuauugcuugaugggaagcggccagcuacugugggacacagugaccggugucgauauggcucucuga

SEQ ID NO: 151869 - RNA, 1401 nt, Artificial Sequence
  derived and/or modified sequence opt3 from neuraminidase__InfluenzaB__AGX24495
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggugguaaacagaucagcggcuaaaggagugacucuccugcugccggaacccgaguggaccuauccuaggcucagcuguccagguaguacauuccagaaggccuuacugauuucuccccaccgguuuggcgaaaccaaaggaaauuccgcaccucuuaucauucgcgagccauucaucgccugcgggcccacugaauguaagcauuuugcuuugacacacuacgcagcccagccuggcgguuauuacaacgggacccgagaggaccguaauaaacugagacaucuaauaagcgucaagcucggaaagaucccaacgguggagaacuccauuuuccacauggcugccuggucaggcagugcgugccaugauggcaaagaauggacuuauaucgggguugacggaccggauagcaaugcacugcuuaagauuaaauacggugaggccuacaccgacacauaucacucuuacgcuaagaacauccugaggacucaagaauccgccuguaauugcauaggcggggauuguuauuugaugauuaccgacggacccgcaucaggcaucagcgagugccgguuucucaaaauucgcgaggguagaaucaucaaggaaauuuucccuacagggagggugaagcacaccgaggaauguacgugcggauuugcuaguaacaaaacuauagagugugccugccgggauaauucuuacacagcgaagcgcccauucgucaaacugaacguggaaaccgacacugccgagauccgauuaaugugcacagagaccuaucuggauacgcccagaccuaaugacggcuccauuaccggcccaugugaaagcgauggggacaagggaucggguggcaucaaagggggauuuguacaucagaggauggcaucuaagauaggccggugguacucccguacaaugucaaaaacucgcagaauggguauggggcucuauguuaaguacgacggcgaucccuggaccgacagugaggcucuugcccugagcggagugauggucuccauggaggaaccgggcugguacucuuucggguuugaaauuaaggauaaaaagugcgacgugccuuguaucggaaucgagauggugcacgaugguggcaaaacaacuuggcauagcgcugccaccgcaauuuauugcuugauggggucaggacagcuacugugggacacagucaccggcguugauauggcccucuga

SEQ ID NO: 151870 - RNA, 1401 nt, Artificial Sequence; identical to SEQ ID NO: 151428
  derived and/or modified sequence opt3 from neuraminidase__InfluenzaB__AGX24506

SEQ ID NO: 151871 - RNA, 1401 nt, Artificial Sequence
  derived and/or modified sequence opt3 from neuraminidase__InfluenzaB__AGX24517
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcugccaaaggaguaacucuccugcugccggaacccgaguggaccuauccuagacucagcuguccagguaguacauuccagaaggcauuacugauuucuccccauagguuuggcgaaaccaaaggcaauuccgccccucuuaucauucgggagccauucaucgcuugcggacccacugaauguaagcacuuugcauugacacauuacgccgcucagccuggcgguuauuacaacgggacccgcgaggaccgaaauaaacugcgucaccuaauaagcgugaagcucggaaagaucccaacggucgagaacuccauuuuccauauggccgcguggucaggcagugcaugccacgauggcaaagaauggacuuauaucgggguggacggaccggauagcaaugcccugcuuaagauuaaauacggugaggcuuacaccgacacauaucacucuuacgccaagaacauccugagaacucaagaauccgcauguaauugcauaggcggggauuguuauuugaugauuaccgacggacccgcuucaggcguuagcgagugcagguuucucaaaauccgggagggucgcauuaucaaggaaaucuucccuacagggagagugaagcauaccgaggaauguacgugcggauuugccaguaacaaaacuauugagugugcgugcagggauaauucuuacacagccaagcggccauucgucaaacugaacguggaaaccgacacugcagagauacgcuuaaugugcacagagaccuaucuggauacgccccgaccuaaugacggcuccaucaccggcccaugugaaagcgauggggacaagggaucggguggcauuaaagggggauuuguacaccagagaauggcuucuaagaucgggaggugguacucccggacaaugucaaaaacuaagcguauggguauggggcucuauguuaaguacgacggcgaucccuggaccgacagugaggcccuugcucugagcggagugauggucuccauggaggaaccgggcugguacucuuucggguuugaaauaaaagauaagaaaugcgacgugccuuguauuggaaucgagauggugcaugaugguggcaagacaacuuggcacagcgccgcaaccgccaucuauugcuugauggggucaggacagcuacugugggacacagucaccggcguugauauggcucucuga

SEQ ID NO: 151872 - RNA, 1401 nt, Artificial Sequence; identical to SEQ ID NO: 151428
  derived and/or modified sequence opt3 from neuraminidase__InfluenzaB__AGX24528

SEQ ID NO: 151873 - RNA, 1401 nt, Artificial Sequence; identical to SEQ ID NO: 151856
  derived and/or modified sequence opt3 from neuraminidase__InfluenzaB__AGX24539

SEQ ID NO: 151874 - RNA, 1401 nt, Artificial Sequence
  derived and/or modified sequence opt3 from neuraminidase__InfluenzaB__AGX24550
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugauuccggaacccgaguggaccuauccuaggcugagcuguccagguaguacauuccagaaggcacucuuaaucucuccccaccgguuuggcgaaaccaaaggaaauuccgccccucugauuauccgcgagccauucauagcuugcgggcccacugaauguaagcauuuugcacuuacacacuacgccgcucagccuggcgguuauuacaacgggacccgagaggaccguaauaaauugagacaucugaucagcgugaagcuaggaaagauuccaacggucgagaacuccaucuuccacauggccgcguggucaggcagugcaugccaugauggcaaagaauggacuuauauugggguggacggaccggauagcaaugcccuccugaagaucaaauacggugaggcuuacaccgacacauaucacucuuacgccaagaacauacuuaggacucaagaauccgcauguaauugcauuggcggggauuguuaucugaugaucaccgacggacccgcuucaggcauuagcgagugccgguuuuugaaaauccgcgaggguagaaucauuaaggaaauauucccuacagggaggguuaagcacaccgaggaauguacgugcggauuugccaguaacaaaacuaucgagugugcgugccgggauaauucuuacacagccaagcgcccauucgugaaacucaacgucgaaaccgacacugcagagauucgacugaugugcacagagaccuauuuagauacgcccagaccuaaugacggcuccaucaccggcccaugugaaagcgauggggacaagggaucggguggcauaaaagggggauuugugcaucagaggauggcuucuaagauuggccggugguacucccguacaaugucaaaaacuaagcgcauggguauggggcuguauguaaaguacgacggcgaucccuggaccgacagugaggcccucgcucuuagcggaguuaugguguccauggaggaaccgggcugguacucuuucggguuugaaaucaaagauaagaaaugcgacgucccuuguaucggaauugagauggugcacgaugguggcaagacaacuuggcauagcgccgcaaccgccaucuauugccugauggggucaggacaguugcuaugggacacagugaccggcgucgauauggcucuguga

SEQ ID NO: 151875 - RNA, 1401 nt, Artificial Sequence; identical to SEQ ID NO: 151866
  derived and/or modified sequence opt3 from neuraminidase__InfluenzaB__AGX24561

SEQ ID NO: 151876 - RNA, 1401 nt, Artificial Sequence; identical to SEQ ID NO: 150833
  derived and/or modified sequence opt3 from neuraminidase__InfluenzaB__AGX24572

SEQ ID NO: 151877 - RNA, 1401 nt, Artificial Sequence
  derived and/or modified sequence opt3 from neuraminidase__InfluenzaB__AGX24583
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacucgcagaauggguauggggcucuauguaaaguacgacggcgaucccuggaccgacaguggagcccuugcucugagcggcguuaugguguccauugaggaaccggggugguacucuuucggauuugagaucaaggauaaaaagugcgacgucccuuguaucgguauugaaauggugcacgauggcgggaaaacaacuuggcauagcgccgcaaccgccaucuauugcuugaugggaucaggccagcuacugugggacacagugaccggugucgauauggcucucuga

SEQ ID NO: 151878 - RNA, 1401 nt, Artificial Sequence; identical to SEQ ID NO: 151428
  derived and/or modified sequence opt3 from neuraminidase__InfluenzaB__AGX24594

SEQ ID NO: 151879 - RNA, 1401 nt, Artificial Sequence; identical to SEQ ID NO: 151428
  derived and/or modified sequence opt3 from neuraminidase__InfluenzaB__AGX24605

SEQ ID NO: 151880 - RNA, 1401 nt, Artificial Sequence; identical to SEQ ID NO: 151428
  derived and/or modified sequence opt3 from neuraminidase__InfluenzaB__AGX24616

SEQ ID NO: 151881 - RNA, 1401 nt, Artificial Sequence; identical to SEQ ID NO: 151852
  derived and/or modified sequence opt3 from neuraminidase__InfluenzaB__AGX24627

SEQ ID NO: 151882 - RNA, 1401 nt, Artificial Sequence; identical to SEQ ID NO: 151428
  derived and/or modified sequence opt3 from neuraminidase__InfluenzaB__AGX24638

SEQ ID NO: 151883 - RNA, 1401 nt, Artificial Sequence
  derived and/or modified sequence opt3 from neuraminidase__InfluenzaB__AGX24660
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacauacuaugcagcccagccuggcgguuacuauaacgggacccgugaggacagaaauaagcugaggcaccuaauaagcgugaagcucggaaaaaucccaacggucgagaacuccauuuuccauauggcugccuggucaggcagugcgugccacgauggccgggaauggacuuacaucgggguggacggaccggauagcaaugcacugcuuaagauuaaauacggugaggccuauaccgacacauaccauucuuaugcuaagaacauccugcgcacucaggaauccgccuguaauugcauaggcggggauuguuacuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuauacagcgaagagaccauucgugaaacugaacgucgaaaccgacacugccgagaucagguuaaugugcacagagaccuaccuggauacgccccggccuaaugacggcuccauuaccggcccaugugaaagcaacggggauaagggaucggguggcaucaaagggggauuugugcaccaacguauggcaucuaagauaggccgcugguauuccagaacaaugucaaaaacuaagaggauggguauggggcucuacguaaaguacgacggcgaccccuggaccgauagugaggcucuugcccugagcggaguuaugguguccauggaggaaccgggcugguauucuuucggguuugaaauuaaagacaagaaaugcgaugucccuuguaucggaaucgagauggugcaugacgguggcaagacaacuuggcacagcgcugccaccgcaauuuacugcuugauggggucaggacagcuacugugggauacagugaccggcgucaauaugacucucuga

SEQ ID NO: 151884 - RNA, 1401 nt, Artificial Sequence
  derived and/or modified sequence opt3 from neuraminidase__InfluenzaB__AGX24671
augcugcccagcaccauccagacacucacucuuuuccugacguccggcgggguguuguuacugcuauacgucucugccucacucaguuaucugcuuuacagcgacauucuguugaaguuuucccaaaccgagauaacagcuccuaucaugccacucgauugcgcaaacgccucuaauguucaggcggugaacagaucggcugccaaaggaguaacucugcugcucccggaacccgaguggaccuauccuagguuaucauguccagguagcacauuccagaaggcacugcuuauuaguccccaccgguuuggcgaaaccaaaggaaauuccgccccuuugaucauucgcgagccauucaucgcuugcgggcccacugaauguaagcauuuugcacugacacacuacgccgcucagccuggcgguuauuacaacgggacccgagaggaccguaauaaacuaagacaucucauaucugugaagcugggaaagaucccaacggucgagaacagcauuuuccacauggccgcgugguccggcucagcaugccaugauggcaaagaauggacuuauaucgggguggacggaccggauaguaaugcccuucugaagauuaaauacggugaggcuuacaccgacacauaucacagcuacgccaagaacaucuugaggacucaagaaucugcauguaauugcauaggcggggauuguuaucucaugauuaccgacggacccgcuuccggcaucucagagugccgguuucugaaaauucgcgaggguagaaucaucaaggaaauuuucccuacagggaggguuaagcacaccgaggaauguacgugcggauuugccagcaacaaaacuauagagugugcgugccgggauaauaguuacacagccaagcgcccauucgugaaauuaaacgucgaaaccgacacugcagagauccgacugaugugcacagagaccuaucucgauacgcccagaccuaaugacggcucuauuaccggcccaugugaauccgauggggacaagggaagcgguggcaucaaagggggauuugugcaucagaggauggcuucgaagauaggccggugguacucucguacaauguccaaaacuaagcgcauggguauggggcuuuauguaaaguacgacggcgaucccuggaccgacucagaggcccuggcuuugaguggaguuauggugagcauggaggaaccgggcugguacuccuucggguuugaaauuaaagauaagaaaugcgacaucccuuguaucggaauugagaugguccacgaugguggcaagacaacuuggcauucugccgcaaccgccaucuauugccuaauggggagcggacagcugcucugggacacagugaccggcguggauauggcucuguga

SEQ ID NO: 151885 - RNA, 1401 nt, Artificial Sequence
  derived and/or modified sequence opt3 from neuraminidase__InfluenzaB__AGX24682
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcaacggggauaagggaucggguggcaucaaagggggauuugugcaucaacguauggcaucuaagauaggccgcugguacuccagaacaaugucaaaaacuaagaggauggguauggggcucuauguaaaguacgacggcgaccccuggaccgauagugaggcucuuguucugagcggagugauggucuccauggaggaaccgggcugguacucuuucggguuugaaauuaaagacaagaaaugcgaugugccuuguaucggaaucgagauggugcacgacgguggcaagacaacuuggcauagcgccgcuaccgccauuuauugcuugauggggucaggacagcuacugugggauacagucaccggcguuaauaugacucucuga

SEQ ID NO: 151886 - RNA, 1401 nt, Artificial Sequence; identical to SEQ ID NO: 151428
  derived and/or modified sequence opt3 from neuraminidase__InfluenzaB__AGX24693

SEQ ID NO: 151887 - RNA, 1401 nt, Artificial Sequence; identical to SEQ ID NO: 151428
  derived and/or modified sequence opt3 from neuraminidase__InfluenzaB__AGX24704

SEQ ID NO: 151888 - RNA, 1401 nt, Artificial Sequence; identical to SEQ ID NO: 151428
  derived and/or modified sequence opt3 from neuraminidase__InfluenzaB__AGX24715

SEQ ID NO: 151889 - RNA, 1401 nt, Artificial Sequence
  derived and/or modified sequence opt3 from neuraminidase__InfluenzaB__AGX24737
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggacuacagaauguaagcauuuugcauugacccacuacgccgcucagcccggcgguuauuacaacgggacgcgagaggaccguaauaaacugagacaucuaauaagcgugaagcucggaaagaucccuacugucgagaacuccauuuuccacauggccgcguggucaggcagugcaugccaugauggcaaagaauggaccuauaucgggguggacggaccagauagcaaugcccugcuuaagauuaaauacggugaggcuuacacagacacuuaucacucuuacgccaagaacauccugaggacccaagaauccgcauguaauugcauaggcggggauuguuauuugaugauuacagacggaccggcuucaggcaucagcgagugccgguuucucaaaauucgcgaggguagaaucaucaaggaaauuuuccccaccgggaggguuaagcacacggaggaauguacuugcggauuugccaguaacaaaacaauagagugugcgugccgggauaaucgcuacaccgccaagcgaccuuucgugaaacugaacgucgaaacugacacagcagagaucagauuaaugugcaccgagacguaucuggauaccccaaggcccaaugacggcucuauuacaggcccuugugaauccgauggggacaagggaagcgguggcaucaaagggggauuugugcaucagcggauggcuucgaagauaggccguugguacucucgcacuauguccaaaaccaagagaauggguauggggcucuauguaaaguacgacggcgauccauggacagacucaggagcccuugcucugaguggcguuauggugagcauugaggaacccgggugguacuccuucggauuugagaucaaagauaagaaaugcgacgucccguguaucgguauugaaauggugcacgauggcgggaagacuaccuggcauucugccgcaacagccaucuauugcuugaugggaagcggccagcuacugugggacaccgugacuggugucgauauggcucucuga

SEQ ID NO: 151890 - RNA, 1401 nt, Artificial Sequence
  derived and/or modified sequence opt3 from neuraminidase__InfluenzaB__AGX24748
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggccgauauuacaacgguacccgugaggacagaaauaaacugaggcaucuaauaagcgugaagcucgggaagaucccaacggucgagaacuccauuuuccacauggccgcguggucaggaagugcaugccaugauggcaaagaauggacuuauaucggcguggacgggccggauagcaaugcccugcuuaagauuaaauacggagaggcuuacaccgacacauaucacucuuacgccaagaacauccugcggacucaagaauccgcauguaauugcauagguggcgauuguuauuugaugauuaccgacgggcccgcuucaggaaucagcgagugccgcuuucucaaaauuagagagggcaggaucaucaaggaaauuuucccuacaggucggguuaagcacaccgaggaauguacgugcggguuugccaguaacaaaacuauagagugugcgugccgcgauaauucuuacacagccaagcgaccauucgugaaacugaacgucgaaaccgacacugcagagaucagauuaaugugcacagagaccuaucuggauacgcccaggccuaaugacggauccauuaccggcccaugugaaagcgauggcgacaaggggucgggagguaucaaaggcggguuugugcaucagcggauggcuucuaagauaggacguugguacucccgcacaaugucaaaaacuaagagaaugggcaugggucucuauguaaaguacgacggggaucccuggaccgacagugaggcccuugcucugagcggcguuaugguguccauggaggaaccgggaugguacucuuucggcuuugaaauuaaagauaagaaaugcgacgucccuuguaucgggaucgagauggugcacgauggagguaagacaacuuggcauagcgccgcaaccgccguguauugcuugaugggcucagggcagcuacugugggacacagucaccggaguugauauggcucucuga

SEQ ID NO: 151891 - RNA, 1401 nt, Artificial Sequence
  derived and/or modified sequence opt3 from neuraminidase__InfluenzaB__AGX24759
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugguguccauggaggaaccgggcugguacucuuucggguuugaaauuaaagauaagaaaugcgacaucccuuguaucggaauugagaugguccacgaugguggcaagacaacuuggcauagcgccgcaaccgccaucuauugcuugauggggucaggacagcuacugugggacacagugaccggcguggauauggcucucuga

SEQ ID NO: 151892 - RNA, 1401 nt, Artificial Sequence; identical to SEQ ID NO: 151428
  derived and/or modified sequence opt3 from neuraminidase__InfluenzaB__AGX24770

SEQ ID NO: 151893 - RNA, 1401 nt, Artificial Sequence; identical to SEQ ID NO: 151890
  derived and/or modified sequence opt3 from neuraminidase__InfluenzaB__AGX24781

SEQ ID NO: 151894 - RNA, 1401 nt, Artificial Sequence; identical to SEQ ID NO: 150804
  derived and/or modified sequence opt3 from neuraminidase__InfluenzaB__AGX24792

SEQ ID NO: 151895 - RNA, 1401 nt, Artificial Sequence; identical to SEQ ID NO: 151852
  derived and/or modified sequence opt3 from neuraminidase__InfluenzaB__AGX24803

SEQ ID NO: 151896 - RNA, 1401 nt, Artificial Sequence; identical to SEQ ID NO: 151428
  derived and/or modified sequence opt3 from neuraminidase__InfluenzaB__AGX24814

SEQ ID NO: 151897 - RNA, 1401 nt, Artificial Sequence
  derived and/or modified sequence opt3 from neuraminidase__InfluenzaB__AGX24825
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgaguauuacaacgguacccgagaggaccguaauaaacugagacaucuaauaagcgugaagcucgggaagaucccaacggucgaaaacuccauuuuccacauggccgcguggucaggaagugcaugccaugauggcaaagaguggacuuauaucggcguggacgggccggauagcaaugcccugcuuaagauuaaauacggagaggcuuacaccgacacauaucacucuuacgccaagaacauccugaggacucaagaauccgcauguaauugcauagguggcgauuguuauuugaugauuaccgacgggcccgcuucaggaaucagcgagugccgguuucucaaaauucgcgaaggcagaaucaucaaggagauuuucccuacagguaggguuaagcacaccgaagaguguacgugcggguuugccaguaacaaaacuauagaaugugcgugccgggauaauucuuacacagccaagcgcccauucgugaaacugaacgucgagaccgacacugcagagauccgauuaaugugcacagaaaccuaucuggauacgcccagaccuaaugacggauccauuaccggcccaugugagagcgauggcgacaaggggucgggagguaucaaaggcggguuugugcaucagaggauggcuucuaagauaggacggugguacucccguacaaugucaaaaacucgcagaaugggcaugggucucuauguaaaguacgacggggaucccuggaccgacagugaagcccuugcucugagcggcguuaugguguccauggaggaaccgggaugguacucuuucggcuuugagauuaaggauaaaaagugcgacgucccuuguaucgggaucgagauggugcacgauggagguaaaacaacuuggcauagcgccgcaaccgccauuuauugcuugaugggcucagggcagcuacugugggacacagugaccggagucgauauggcucucuga

SEQ ID NO: 151898 - RNA, 1401 nt, Artificial Sequence; identical to SEQ ID NO: 151428
  derived and/or modified sequence opt3 from neuraminidase__InfluenzaB__AGX24836

SEQ ID NO: 151899 - RNA, 1401 nt, Artificial Sequence
  derived and/or modified sequence opt3 from neuraminidase__InfluenzaB__AGX24847
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcaacggggauaagggaucggguggcaucaaagggggauuugugcaucaacguauggcaucuaagauaggccgcugguacuccagaacaaugucaaaaacuaagaggauggguauggggcucuauguaaaguacgacggcgaccccuggaccgauagugaggcucuugcccugagcggaguuaugguguccauggaggaaccgggcugguacucuuucggguuugaaauuaaagacaagaaaugcgaugucccuuguaucggaaucgagauggugcacgacgguggcaagacaacuuggcauagcgcugccaccgcaguguauugcuugauggggucaggacagcuacugugggauacagucaccggcguuaauaugacucucuga

SEQ ID NO: 151900 - RNA, 1401 nt, Artificial Sequence; identical to SEQ ID NO: 150912
  derived and/or modified sequence opt3 from neuraminidase__InfluenzaB__AGX24858

SEQ ID NO: 151901 - RNA, 1401 nt, Artificial Sequence
  derived and/or modified sequence opt3 from neuraminidase__InfluenzaB__AGX24869
augcugcccagcaccauccagacacucacucuuuuccugacguccggcgggguguuguuaucucuguacgucucagccagucuaagcuaucuccuguacuccgacauucuucugaaguuuucuagaaccgagaugacagcuccuauaaugccauugggaugcgcaaacgccucgaauguucaagcggugaacaggucagcuacuaaagguguaacccuccugcugccggaacccgaguggacauauccucggcucagcuguccaggcaguaccuuccagaaggccuuacugaucucuccccaccgcuuuggggaaacuaaaggaaauuccgcaccucuuauuauccgagagccauucauugccugcggccccaaggaauguaaacauuuugcuuugacacacuacgcagcccagccugguggguauuacaacggaacccgugaggauagaaauaagcugaggcaucuaaucagcgugaagcucggcaaaauaccaacggucgagaacuccaucuuccacauggcugccuggucaggcagugcgugccaugacgggcgggaauggacuuauauuggaguggaugguccggacagcaaugcacugcuuaagaucaaauacggcgaggccuacaccgauacauaucacucuuacgcuaagaacauucugcgcacucaggaauccgccuguaauugcaucgggggagacuguuauuugaugauaaccgauggccccgcaucagguauuagcgagugcagauuucucaaaaucagggaggggcggauuaucaaggaaaucuucccuacaggacgcguuaagcacaccgaggaauguacgugcggcuuugcuaguaacaaaacuauugagugugccugccgagacaauucuuacacagcgaagagaccauucgugaaacugaacgucgaaaccgauacugccgagauaagguuaaugugcacagagaccuaucuggacacgccccggccuaaugauggcuccaucaccgggccaugugaaagcaacggagacaaggguucgggcgggauuaaaggaggcuuugugcaucaacguauggcaucuaagaucggucgcugguacuccagaacaaugucaaaaacuaagaggauggggaugggccucuauguaaaguacgauggagaccccuggaccgacagugaggcucuugcccugagcggcguuaugguguccauggaggaaccggggugguacucuuucggauuugaaauaaaagauaagaaaugcgacgucccuuguauugguaucgagauggugcacgauggcgggaagacaacuuggcauagcgcugccaccgcaaucuauugcuugaugggaucaggccagcuacugugggacacagugaccggugucaauaugacucucuga

SEQ ID NO: 151902 - RNA, 1401 nt, Artificial Sequence
  derived and/or modified sequence opt3 from neuraminidase__InfluenzaB__AGX24880
augcugcccagcaccauccagaugcucacacuuuuccugacuuccggcgggguguuguuaucucuguacgucucagccagucuaagcuaucuccuguacuccgacauucuucugaaguuuucuagaacggagauaaccgcuccuaucaugccauuggauugcgcaaacgccucgaauguucaagcggugaacaggucagcuacaaaaggaguaacucuccugcugccggaacccgaguggaccuauccucggcucagcuguccagguaguacauuccagaaggccuuacugauuucuccccaccgcuuuggcgaaaccaaaggaaauuccgcaccucuuaucauucgagagccauucaucgccugcgggcccaaggaauguaaacauuuugcuuugacucacuacgcagcccagccuggcgguuauuacaacgggacacgugaggacagaaauaagcugaggcaucuaauaagcgugaagcucggaaaaaucccaaccgucgagaacuccauuuuccacauggcugccuggucaggcagugcgugccaugauggccgggaauggacguauaucgggguggacggaccggauagcaaugcacugcuuaagauuaaauacggugaggccuacacugacaccuaucacucuuacgcuaagaacauccugcgcacacaggaauccgccuguaauugcauaggcggggauuguuauuugaugauuacugacggacccgcaucaggcaucagcgagugcagauuucucaaaauuagggagggucggaucaucaaggaaauuuucccuaccgggcgcguuaagcacacagaggaauguaccugcggauuugcuaguaacaaaacgauagagugugccugccgagauaauucuuacacugcgaagagaccauucgugaaacugaacgucgaaacagacaccgccgagaucagguuaaugugcacugagacauaucuggauacgccccggccuaaugacggcuccauuaccggcccaugugaaagcaacggggauaagggaucggguggcaucaaagggggauuugugcaucaacguauggcaucuaagauaggccgcugguacuccagaaccaugucaaaaacaaagaggauggguauggggcucuauguaaaguacgacggcgaccccuggacugauagugaggcucuugcccugagcggaguuaugguguccauggaggaaccgggcugguacucuuucggguuugaaauuaaagacaagaaaugcgaugucccuuguaucggaaucgagauggugcacgacgguggcaagaccacauggcauagcgcugccacugcaauuuauugcuugauggggucaggacagcuacugugggauaccgugacaggcgucaauaugacccucuga

SEQ ID NO: 151903 - RNA, 1401 nt, Artificial Sequence
  derived and/or modified sequence opt3 from neuraminidase__InfluenzaB__AGX24902
augcugcccagcaccauccagacacucacucuuuuccugacguccggcgggguguuguuaucucuguacgucucagcccuacucaguuaucugcuuuacagcgacauucuguugaaguuuuccagaaccgagauaacagcuccuaucaugccacucgauugcgcaaacgccucuaauguucaagcggugaacaggucggcuacuaaaggaguaacccugcugcucccggaacccgaguggacauauccucgguuaucauguccagguagcaccuuccagaaggcccugcuuauuaguccccaccgcuuuggcgaaaauaaagggaacuccgcaccuuugaucauucgagagccauucaucgccugcggacccaaggaauguaaacauuuugcucugacucacuacgcagcccagccuggcgguuauuacaaugggacacgugaggacagaaacaagcuaaggcaucucauaucugugaagcugggaaaaaucccaaccgucgagaauagcauuuuccacauggcugccugguccggcucagcgugccaugauggccgggaauggacguauaucgggguggacggaccggauaguaacgcacuucugaagauuaaauacggugaggccuacacugacaccuaucacagcuacgcuaagaauaucuugcgcacacaggaaucugccuguaacugcauaggcggggauuguuaucucaugauuacugacggacccgcauccggcaucucagagugcagauuucugaaaauuagggagggucggaucaucaaggaaauuuucccuaccgggcgcguuaagcacacagaggaauguaccugcggauuugcuagcaauaaaacgauagagugugccugccgagauaacaauuacacugcgaagagaccauucgugaaauuaaacgucgaaacagacaccgccgagaucaggcugaugugcacugagacauaucucgauacgccccggccuaaugacggcaguauuaccggcccaugugaaucuaacggggauaagggauccgguggcaucaaagggggauuugugcaucaacguauggcaagcaagauaggccgcugguacucgagaaccaugucuaaaacaaagaggauggguauggggcuuuauguaaaguacgacggcgaccccuggacugauuccgaggcucuggccuugucaggaguuauggugaguauggaggaaccgggcugguacagcuucggguuugaaauuaaagacaagaaaugcgaugucccuuguaucggaaucgagauggugcacgacgguggcaagaccacauggcauuccgcugccacugcaauuuauugccuaauggggucuggacagcugcucugggauaccgugacaggcgucaacaugacccuguga

SEQ ID NO: 151904 - RNA, 1401 nt, Artificial Sequence; identical to SEQ ID NO: 150917
  derived and/or modified sequence opt3 from neuraminidase__InfluenzaB__AGX84846

SEQ ID NO: 151905 - RNA, 1401 nt, Artificial Sequence; identical to SEQ ID NO: 150972
  derived and/or modified sequence opt3 from neuraminidase__InfluenzaB__AGX84858

SEQ ID NO: 151906 - RNA, 1401 nt, Artificial Sequence; identical to SEQ ID NO: 150917
  derived and/or modified sequence opt3 from neuraminidase__InfluenzaB__AGX84869

SEQ ID NO: 151907 - RNA, 1401 nt, Artificial Sequence
  derived and/or modified sequence opt3 from neuraminidase__InfluenzaB__AGX84880
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugucguuggauugcgcaaacgccucaaauguucaagcggugaacagaagcgcuaccaaaggaguaaucuuccuccugccggaacccgaguggacauauccuaggcugaguuguccagguuccaccuuucagaaggcccucuuaauuucuccccaccgguucggcgaaacuaaagggaauagcgcaccucugaucauucgcgagccauuuaucgccugcggacccaacgaauguaagcauuucgcucuuacacacuacgcagcccagccuggcgguuauuacaaugggacccgaggagaccguaacaaauugagacaucugauauccgugaagcuaggcaagaucccaacggucgaaaauucaauuuuucacauggcugccuggaguggcagcgcgugccaugaugggaaagaguggacuuauaucggaguggacgguccggauaacgacgcacuccugaagguuaaauacggcgaggccuacaccgauacauaucacucuuacgcuaauaagauucuuaggacucaggaguccgccuguaacugcaucgggggaaauuguuaucugaugauaaccgacggcucagcaagcggugugagugaaugccgguucuugaaaauucgcgaggggagaaucauuaaggagaucuuucccacaggaagggucaagcacaccgaagaguguacgugcggcuucgcuucuaacaaaacuaucgaaugugccugccgggauaauuccuacacagcgaagcgcccuuuugugaaacucaacguagagaccgacacugccgaaauucgacugaugugcacagauaccuauuuagacacgccaagacccgaugacggcagcauaaccgggccuugugagucgaauggagacaaggguucuggcgggaucaaaggaggcuucguucaucaaaggauggaguccaagauuggucggugguacucacguacaaugaguaaaacugaacgcauggggaugggccuguaugugaaguacgauggagacccaugggcagauagcgacgcucucgccuuuuccggcgucauggugucuaugaaggagcccgggugguacagcuucggauucgaaaucaaagauaagaaaugcgacgugccguguauagguauugagaugguccacgauggcgggaaggaaaccuggcauucagcugccacagcaaucuauugccuuaugggaaguggccagcuguugugggacacuguuaccgguguggauauggcccuauga

SEQ ID NO: 151908 - RNA, 1401 nt, Artificial Sequence; identical to SEQ ID NO: 150917
  derived and/or modified sequence opt3 from neuraminidase__InfluenzaB__AGX84891

SEQ ID NO: 151909 - RNA, 1401 nt, Artificial Sequence; identical to SEQ ID NO: 150972
  derived and/or modified sequence opt3 from neuraminidase__InfluenzaB__AGX84902

SEQ ID NO: 151910 - RNA, 1401 nt, Artificial Sequence
  derived and/or modified sequence opt3 from neuraminidase__InfluenzaB__AGX84924
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauuaugcaaacgccucgaauguucaagcggugaacagaucagcuaccaaaggaguaacauuccugcugccggaacccgaguggaccuacccuaggcucagcugcccagguaguacuuuucagaaggccuuacugaucucuccccaccgguucggcgaaacaaaaggaaauuccgcaccucuuauuauccgcgagccauuuauugccugugggcccaacgaaugcaagcauuucgcuuugacccacuaugcagcccagccuggcgguuacuauaaugggacgcgaggagaccguaacaaacugagacaucuaaucagcgugaagcucggcaagauaccaacugucgaaaauuccaucuuucacauggcugccuggucaggcagugcgugucaugaugggaaagaguggaccuacauuggaguggacgguccggauaacgacgcacugcuuaagguuaaauacggcgaggccuauacagauacuuaccacagcuaugcuaauaagauccugaggacccaggagucugccugcaacuguauugggggaaauugcuacuugaugaucacagacggcuccgcaucaggugugagcgaaugucgguuccucaaaauacgcgaggggagaauuaucaaggagauuuuucccaccggaagggucaagcacacggaagagugcacuuguggcuucgcuaguaacaaaacaaucgaaugcgccugucgggauaauucuuauaccgcgaagcgcccuuuugugaaacugaacguagagacugacacagccgaaauccgauuaaugugcaccgauacguaccuggacaccccaagacccgaugacggcuccauuacagggccuugcgagagcaauggagacaaggguucgggcgggauaaaaggaggcuucguucaucaaaggauggagucuaagaucggucggugguauucccguacuaugucaaaaaccgaacgcauggggaugggccucuacgugaaguacgauggagacccaugggcagauagugacgcucuugccuuuagcggcgucaugguguccaugaaggagcccgggugguauucuuucggauucgaaauuaaagauaagaaaugugacgugccgugcaucgguauagagaugguccacgauggcgggaaggaaacauggcauagcgcugccacugcaauuuacugucugaugggaucaggccaguugcuaugggacaccguuacagguguggauauggcccuguga

SEQ ID NO: 151911 - RNA, 1401 nt, Artificial Sequence
  derived and/or modified sequence opt3 from neuraminidase__InfluenzaB__AGY46393
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccaccaauguucaagcggugaacagaucggcuacaaaaggaguaacccuccugcugcccgaaccugaguggacuuauccaaggcucucaugucccgguagcacauuccagaaggccuuacugaucaguccucaccgguuuggcgaaauuaaaggaaauuccgcaccacuuaucauucgcgagcccuucaucgccugcgggccuaacgaauguaagcauuuugcuuugacccacuacgcagcccagccaggcgguuauuacaaugggacgcgagaggaccguaacaaacugagacaucuaauaucugugaagcucggaaagaucccgacugucgagaauagcauuuuccacauggcugccugguccggcucagcgugccaugauggcagggaauggaccuauaucgggguggacggacccgauaguaacgcacugcuuaaaauuaaguacggugaggccuacacagacacuuaucacagcuacgcuaaaaauauccugcggacccaggaaucugccuguaacugcauaggcggggauuguuauuugaugauuacagacggaccugcauccggcaucucagagugccgcuuucucaagauuagagaggguaggaucaucaaagaaauuuucccaaccgggcggguuaagcacacggaggaauguacuugcggauuugcuagcaauaagacaauagagugugccugccgcgauaacaguuacaccgcgaaacgacccuucgugaagcugaaugucgaaacugacacagccgagaucagauuaaugugcaccgagacguaucuggauaccccuaggccaaacgacggcucuauuacaggccccugugaauccaauggggauaaaggaagcgguggcaucaaagggggauuugugcaucaacggauggcaucgaagauaggccguugguacucucgcacuauguccaagaccgagagaauggguauggggcucuauguaaaauacgacggcgacccgugggcugauucagacgcccuugcuuucaguggaguuauggugagcauggaggaaccuggcugguacuccuuuggguucgaaauuaaggauaagaaaugcgacguccccuguaucggaaucgagauggugcacgaugguggcaaggagacauggcauucugccgcaacugccauuuauugccugauggggagcggacaguugcuaugggacaccgugacaggcgucaacauggcucuguga

SEQ ID NO: 151912 - RNA, 1401 nt, Artificial Sequence
  derived and/or modified sequence opt3 from neuraminidase__InfluenzaB__AGY46397
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaacgaauguaagcauuuugcuuugacacacuacgcagcccagccuggcgguuauuacaaugggacccguggagacagaaacaaacugaggcaucuaauaagcgugaagcucggcaagaucccaacggucgaaaauuccauuuuccacauggcugccuggucaggcagugcgugccaugaugggaaagaguggacuuauaucggaguggacgguccggauaacaaugcacugcuuaagguuaaauacggcgaggccuacaccgacacauaucacagcuacgcuaacaagauucugcggacucaggagucugccuguaauugcaucgggggaaacuguuauuugaugauaaccgauggcuccgcaucaggugugagcgaaugccgcuuucucaaaauuagagaggggaggaucauuaaggagaucuuccccacaggacgggucaagcacaccgaagaguguacgugcggcuuugcuaguaauaaaacuaucgaaugugccugccgcgacaacucuuacacagcgaagcgaccuuucgugaaacugaauguagagaccgauacugccgaaauuagauuaaugugcacagacaccuaucuggauacgccaaggcccaacgacggcuccauaaccgggccuugugagagcgauggagacaaggguucgggcgggaucaaaggaggcuuuguucaucaacggauggagucuaagauuggucguugguacucccgcacaaugucaaaaacugaaagaauggggaugggccucuaugugaaguacgacggagauccaugggcagacagugaugcucuugccuucagcggcgucaugguguccaugaaggagcccgggugguacucuuuuggauucgaaaucaaagacaagaaaugcgaugugccguguauagguauugagaugguccacgacggcgggaagaccacauggcauagcgcugccacugcaaucuauugccugaugggaucaggccaguugcuaugggauaccguuacaggugugaacaugacccuguga

SEQ ID NO: 151913 - RNA, 1401 nt, Artificial Sequence
  derived and/or modified sequence opt3 from neuraminidase__InfluenzaB__AGY46399
augcugcccagcaccauccagacacucacucuuuuccugacguccggcgggguguuguuaucucuguacgucucagccagucuaagcuaucuccuguacuccgacauucuucugaaguuuucuccuaccgagauaaucgcuccaacaacuccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugauuuccccucaccgguuuggcgaaacaaaaggaaauucugcaccacuuaucauucgcgagcccuucaucgccugcgggccuaaggaauguaaacauuuugcuuugacccacuacgcagcccagccaggcgguuauuacaacgggacgcgagaggaccguaauaagcugagacaucuaauaagcgugaagcucggaaaaaucccgacugucgagaacuccauuuuccacauggcugccuggucaggcagugcgugccaugauggcagggaauggaccuauaucgggguggacggacccgauagcaaugcacugcuuaagauuaaauacggugaggccuacacagacacuuaucacucuuacgcuaagaacauccugcggacccaggaauccgccuguaauugcauaggcggggauuguuauuugaugauuacagacggaccugcaucaggcaucagcgagugccgcuuucucaaaauuagagaggguaggaucaucaaggaaauuuucccaaccgggcggguuaagcacacggaggaauguacuugcggauuugcuaguaacaaaacaauagagugugccugccgcgauaauucuuacaccgcgaagcgacccuucgugaaacugaacgucgaaacugacacagccgagaucagauuaaugugcaccgagacguaucuggauaccccuaggccaaaugacggcuccauuacaggccccugugaaagcaacggggauaagggaucggguggcaucaaagggggauuugugcaucaacggauggcaucuaagauaggccguugguacucccgcacuaugucaaaaaccaagagaauggguauggggcucuauguaaaguacgacggcgacccgugggcugauagugaggcccuugcucugagcggaguuaugguguccauggaggaaccuggcugguacucuuucggguuugaaauuaaagacaagaaaugcgauguccccuguaucggaaucgagauggugcacgacgguggcaaggagacauggcauagcgccgcaacugccauuuauugcuugauggggucaggacagcuacugugggauaccgugacaggcgucgacauggcucucuga

SEQ ID NO: 151914 - RNA, 1401 nt, Artificial Sequence
  derived and/or modified sequence opt3 from neuraminidase__InfluenzaB__AGY46401
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcagggaauggaccuauauugggguggacggacccgauagcaaugcacugcuuaagaucaaauacggugaggccuacacagacacuuaucacucuuacgcuaagaacauucugcggacccaggaauccgccuguaauugcaucggcggggauuguuauuugaugauaacagacggaccugcaucaggcauuagcgagugccgcuuucucaaaaucagagaggguaggauuaucaaggaaaucuucccaaccgggcggguuaagcacacggaggaauguacuugcggauuugcuaguaacaaaacaauugagugugccugccgcgauaauucuuacaccgcgaagcgacccuucgugaaacugaacgucgaaacugacacagccgagauaagauuaaugugcaccgagacguaucuggauaccccuaggccaaaugacggcuccaucacaggccccugugaaagcaacggggauaagggaucggguggcauuaaagggggauuugugcaucaacggauggcaucuaagaucggccguugguacucccgcacuaugucaaaaaccaagagaauggguauggggcucuauguaaaguacgacggcgacccgugggcugauagugacgcccuugcuuucagcggaguuaugguguccaugaaagagccuggcugguacucuuuuggguucgaaauaaaggauaaaaagugcgacguccccuguauuggaaucgagauggugcacgaugguggcaaagaaacauggcauagcgccgcaacugccaucuauugccugauggggucaggacaguugcuaugggacaccgugacaggcgucgauauggcucuguga

SEQ ID NO: 151915 - RNA, 1401 nt, Artificial Sequence; identical to SEQ ID NO: 150632
  derived and/or modified sequence opt3 from neuraminidase__InfluenzaB__AGZ59825

SEQ ID NO: 151916 - RNA, 1401 nt, Artificial Sequence; identical to SEQ ID NO: 150698
  derived and/or modified sequence opt3 from neuraminidase__InfluenzaB__AGZ59836

SEQ ID NO: 151917 - RNA, 1401 nt, Artificial Sequence; identical to SEQ ID NO: 151387
  derived and/or modified sequence opt3 from neuraminidase__InfluenzaB__AGZ59847

SEQ ID NO: 151918 - RNA, 1401 nt, Artificial Sequence
  derived and/or modified sequence opt3 from neuraminidase__InfluenzaB__AGZ59858
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggaaacgaggagaccguaacaagcugagacaccuaaucagcgugaagcucggcaaaauaccgacggucgaaaauuccaucuuccauauggcugccuggucaggcagugcgugccacgaugggaaggaguggacuuauauuggaguggacggucccgauaacaaugcacugcuuaaaaucaaguacggcgaggccuacaccgacacauaucacagcuacgcuaacaauauucugaggacucaggagucugccuguaacugcaucgggggaaauuguuauuugaugauaaccgauggcuccgcaucagguguuagcgaaugccgguuucucaaaauucgcgaggggagaaucauuaaggagaucuucccuacaggaagggugaagcauaccgaagaguguacgugcggcuuugcuaguaacaaaacuaucgaaugugccugccgggacaauucuuacacagcgaagcgcccauucgucaaacugaacguggagaccgauacugccgaaauucgauuaaugugcacagacaccuaucuggauacgcccagaccugacgauggcuccauaaccgggccaugugagagcaacggagacaaggguucgggcgggaucaaaggaggcuuuguacaccagaggauggcaucuaagauuggucggugguacucccguacaaugucaaaaacugagcgcauggggaugggccucuauguuaaguacgacggagaucccugggcugacagugaugcccuugcuuucagcggcgugauggucuccaugaaggaaccggggugguacucuuuuggauucgagaucaaagacaagaaaugcgaugugccuuguauagguauugaaauggugcaugacggcgggaaggagaccuggcacagcgccgcaacagccaucuauugccugaugggaucaggccaauugcuaugggauacugucaccgguguugacauggcucuguga

SEQ ID NO: 151919 - RNA, 1401 nt, Artificial Sequence
  derived and/or modified sequence opt3 from neuraminidase__InfluenzaB__AGZ59869
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccguguuaaucuccccucaccgguuuggcgaaacaaaaggaaauucugcaccacugauuauccgcgagcccuucauugccugcgggccuaacgaauguaagcauuuugcucuuacccacuacgcagcccagccaggcgguuauuacaaugggacgcgaggagaccguaacaaauugagacaucugaucagcgucaagcuaggcaagauaccgacuguggaaaauuccaucuuccacauggcugccuggucaggcagugcgugccaugaugggaaagaguggaccuauauuggaguugacggucccgauaacaaugcacuccugaagaucaaauacggcgaggccuacacagacacuuaucacagcuacgcuaacaagauucuuaggacccaggagucugccuguaauugcaucgggggaaacuguuaucugaugauaacagauggcuccgcaucaggugugagcgaaugccgguuuuugaaaauucgcgaggggagaaucauuaaggagaucuucccuaccggaagggucaagcacacggaagaguguacuugcggcuuugcuaguaauaaaacaaucgaaugugccugccgggacaacucuuacaccgcgaagcgcccauucgugaaacucaauguagagacugauacagccgaaauucgacugaugugcaccgacacguauuuagauacccccagaccugacgauggcuccauaacagggccaugugagagcaacggagacaaggguucgggcgggaucaaaggaggcuuuguucaucaaaggauggcaucuaagauuggucggugguacucccguacuaugucaaaaaccgagcgcauggggaugggccuguaugugaaguacgacggagaucccugggcugacagugaugcccucgcuuucagcggcgucaugguguccaugaaggaaccggggugguacucuuuuggauucgagaucaaagacaagaaaugcgaugugccuuguauagguauugaaaugguccacgacggcgggaaggagacauggcauagcgccgcaacugccaucuauugccuuaugggaucaggccagcuguugugggauaccguuacagguguggacauggcucuauga

SEQ ID NO: 151920 - RNA, 1401 nt, Artificial Sequence; identical to SEQ ID NO: 151416
  derived and/or modified sequence opt3 from neuraminidase__InfluenzaB__AGZ59880

SEQ ID NO: 151921 - RNA, 1401 nt, Artificial Sequence; identical to SEQ ID NO: 151860
  derived and/or modified sequence opt3 from neuraminidase__InfluenzaB__AGZ59891

SEQ ID NO: 151922 - RNA, 1401 nt, Artificial Sequence; identical to SEQ ID NO: 150977
  derived and/or modified sequence opt3 from neuraminidase__InfluenzaB__AGZ59902

SEQ ID NO: 151923 - RNA, 1401 nt, Artificial Sequence; identical to SEQ ID NO: 150977
  derived and/or modified sequence opt3 from neuraminidase__InfluenzaB__AGZ59913

SEQ ID NO: 151924 - RNA, 1401 nt, Artificial Sequence; identical to SEQ ID NO: 150977
  derived and/or modified sequence opt3 from neuraminidase__InfluenzaB__AGZ59924

SEQ ID NO: 151925 - RNA, 1401 nt, Artificial Sequence; identical to SEQ ID NO: 150977
  derived and/or modified sequence opt3 from neuraminidase__InfluenzaB__AGZ59935

SEQ ID NO: 151926 - RNA, 1401 nt, Artificial Sequence; identical to SEQ ID NO: 150977
  derived and/or modified sequence opt3 from neuraminidase__InfluenzaB__AGZ59946

SEQ ID NO: 151927 - RNA, 1401 nt, Artificial Sequence
  derived and/or modified sequence opt3 from neuraminidase__InfluenzaB__AGZ59957
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccugggcagauagugacgcucuugccuucagcggcgucaugguguccaugaaggagccggggugguacucuuuuggauucgaaauuaaagauaagaaaugcgacgugccuuguaucgguauagagaugguccacgauggcgggaagggaacauggcauagcgcugccacugcaauuuauugccugaugggcucaggucaguugcuaugggacaccguuacagggguggauauggcccuguga

SEQ ID NO: 151928 - RNA, 1401 nt, Artificial Sequence; identical to SEQ ID NO: 150977
  derived and/or modified sequence opt3 from neuraminidase__InfluenzaB__AGZ59969

SEQ ID NO: 151929 - RNA, 1401 nt, Artificial Sequence; identical to SEQ ID NO: 150977
  derived and/or modified sequence opt3 from neuraminidase__InfluenzaB__AGZ59980

SEQ ID NO: 151930 - RNA, 1401 nt, Artificial Sequence; identical to SEQ ID NO: 150977
  derived and/or modified sequence opt3 from neuraminidase__InfluenzaB__AGZ59991

SEQ ID NO: 151931 - RNA, 1401 nt, Artificial Sequence; identical to SEQ ID NO: 150977
  derived and/or modified sequence opt3 from neuraminidase__InfluenzaB__AGZ60003

SEQ ID NO: 151932 - RNA, 1401 nt, Artificial Sequence
  derived and/or modified sequence opt3 from neuraminidase__InfluenzaB__AGZ60014
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaagcaaagggaaauuccgccccucuuauuauccgagagccauuuauugcuugcgggcccaacgaauguaaacauuucgcauugacacacuacgccgcucagccuggcgguuauuacaaugggacccguggagacagaaacaagcugaggcaucuaaucagcgugaaacucggcaagauaccaacggucgaaaauuccaucuuucacauggccgcguggucaggcagugcaugccaugaugggaaggaguggacuuauauuggaguggacgguccggauaacgacgcccugcuuaaaguuaaguacggcgaggcuuacaccgauacauaucacagcuacgccaauaaaauccugcggacucaggagucugcauguaacugcauugggggaaauuguuauuugaugaucaccgacggcuccgcuucaggugugagcgaaugccgcuuccucaagauaagagaggggcaaauuaucaaagagauuuuucccacaggaagggucaagcacaccgaagaguguacgugcggcuucgccaguaacaagacuaucgaaugugcgugccgggauaauucuuacacagccaaacgcccuuuugugaagcugaacguagagaccgacacugcagaaauccgauuaaugugcacagauaccuaucuggacacgccaagacccgaugacggcuccauuaccgggccuugugagagcaauggagacaaagguucgggcgggauaaagggaggcuucguucaucagaggauggagucuaaaaucggucggugguacucccguacaaugucaaagacugaacgcauggggaugggccucuaugugaaauacgauggagacccaugggcugauagugacgcccuugcuuuuagcggcgucaugguguccaugaaggagcccgggugguacucuuucggauucgaaauuaaggauaaaaagugcgacgugccguguaucgguauagagaugguccacgauggcgggaaagaaaccuggcauagcgccgcaacagccauuuauugccugaugggaucaggccaguugcuaugggacacuguuaccgguguggauauggcucuguga

SEQ ID NO: 151933 - RNA, 1401 nt, Artificial Sequence; identical to SEQ ID NO: 150911
  derived and/or modified sequence opt3 from neuraminidase__InfluenzaB__AGZ60025

SEQ ID NO: 151934 - RNA, 1401 nt, Artificial Sequence
  derived and/or modified sequence opt3 from neuraminidase__InfluenzaB__AGZ60037
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauuuuucccaccggaagggucaagcacacggaagaguguacuugcggcuucgcuaguaacaaaacaaucgaaugugccugccgggauaauucuuacaccgcgaagcgcccuuuugugaaacugaacguagagacugacacagccgaaauccgauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagagagugaugcucuugccuuuagcggcgucaugguguccaugaaggaacccgggugguacucuuucggauucgagauuaaagacaagaaaugcgaugugccguguaucgguauagaaaugguccacgacggcgggaaggagacauggcauagcgcugccacugcaauuuauugccugaugggaucaggccaguugcuaugggauaccguuacagguguggacaucgcccuguga

SEQ ID NO: 151935 - RNA, 1401 nt, Artificial Sequence; identical to SEQ ID NO: 151147
  derived and/or modified sequence opt3 from neuraminidase__InfluenzaB__AGZ60048

SEQ ID NO: 151936 - RNA, 1401 nt, Artificial Sequence; identical to SEQ ID NO: 151147
  derived and/or modified sequence opt3 from neuraminidase__InfluenzaB__AGZ60059

SEQ ID NO: 151937 - RNA, 1401 nt, Artificial Sequence
  derived and/or modified sequence opt3 from neuraminidase__InfluenzaB__AGZ60070
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccauuggauugcgcaaacgccucgaauguucaagcggugaaccacucagcugccaaaggaguaacacuccugcugccggaacccgaguggaccuauccuagacucagcuguccagguaguacuuuccagaaggcauuacugaucucuccccauagguuuggcgaaacaaaaggcaauuccgccccucuuauuauccgggagccauucauugcuugcggacccaaggaauguaaacacuuugcauugacccauuacgccgcucagccuggcgguuauuacaacgggacgcgcgaggaccgaaauaagcugcgucaccuaaucagcgugaagcucggaaaaauaccaacugucgagaacuccaucuuccauauggccgcguggucaggcagugcaugccacgauggcaaggaauggaccuauauugggguggacggaccggauagcaaugcccugcuuaaaaucaaguacggugaggcuuacacagacacuuaucacucuuacgcccauaacauucugagaacccaggaauccgcauguaauugcaucggcgggaacuguuauuugaugauaacagauggaucagcuagcggcauuagugagugcagguuucucaaaauccgggagggucgcauuaucaaggaaaucuuccccaccgggagaguuaagcacacggaggaauguacuugcggauuugccaauaacaaaacaauugagugugcgugcagggacaauucuuacaccgccaagcggccuuucgugaaacugaacgucgaaacugauacagcagagauacgcuuaaugugcaccgagacguaucuggacaccccacgacccgaugacggcuccaucacaggcccuugugaaagcaaugggaacaagggaucggguggcauuaaagggggauuugugcaucaaagaauggcuucuaagaucgggaggugguacucccggacuaugucaaaaaccaagcguauggguauggggcucuauguaaaguacgauggcgacccauggacagacagugaugcccuuguuuucagcggagugaugauauccgucgaggaacccggcugguacucuuuuggguucgagauuaaagacaagaaaugcgaugugccguguaucggaaucgaaauggugcacgacgguggcaaggagacuuggcacagcgcugccaccgcaauuuauugccugauggggucaggacaguugcuaugggauacagucaccggcguuaacaugacucuguga

SEQ ID NO: 151938 - RNA, 1401 nt, Artificial Sequence; identical to SEQ ID NO: 150643
  derived and/or modified sequence opt3 from neuraminidase__InfluenzaB__AGZ60081

SEQ ID NO: 151939 - RNA, 1401 nt, Artificial Sequence; identical to SEQ ID NO: 151163
  derived and/or modified sequence opt3 from neuraminidase__InfluenzaB__AGZ60092

SEQ ID NO: 151940 - RNA, 1401 nt, Artificial Sequence; identical to SEQ ID NO: 151786
  derived and/or modified sequence opt3 from neuraminidase__InfluenzaB__AGZ60103

SEQ ID NO: 151941 - RNA, 1401 nt, Artificial Sequence; identical to SEQ ID NO: 150804
  derived and/or modified sequence opt3 from neuraminidase__InfluenzaB__AGZ60135

SEQ ID NO: 151942 - RNA, 1401 nt, Artificial Sequence; identical to SEQ ID NO: 150976
  derived and/or modified sequence opt3 from neuraminidase__InfluenzaB__AGZ60154

SEQ ID NO: 151943 - RNA, 1401 nt, Artificial Sequence
  derived and/or modified sequence opt3 from neuraminidase__InfluenzaB__AGZ60164
augcugcccagcaccacacagacucucacgcuuuuccugaccuccggcgggguguuguuaucucuguacgucucagccagucuaagcuaucuccuguacuccgacauccuucugaaguuuucucaaacagagauuacugcuccuauaaugccauuggauugcgcaaacgccucgaauguucaggcggugaacagaucagcugccaaaggaguaacccuccugcugccggaacccgaguggacauauccuaggcucagcuguccagguaguaccuuccagaaggcauuacugaucaauccccaccgguuuggcgaaacuaaagggaacuccgccccucuuauuauccgcgagccauucauugcuugcggacccacagaauguaagcauuuugcauugacccacuacgccgcucagccuggcgguuauuacaaugggacgcgagaggaccguaacaaacugagacaucuaaucucugugaagcucggaaagauaccaacugucgagaauagcaucuuccacauggccgcgugguccggcucagcaugccaugauggcaaagaauggaccuauauugggguggacggaccggauaguaacgcccugcuuaagaucaaauacggugaggcuuacacagacacuuaucacagcuacgccaagaauauucugaggacccaagaaucugcauguaacugcaucggcggggauuguuauuugaugauaacagacggacccgcuuccggcauuucagagugccgguuucucaaaauccgcgaggguagaauuaucaaggaaaucuucccuaccgggaggguuaagcacacggaggaauguacuugcggauuugccagcaauaaaacaauugagugugcgugccgggauaacaguuacaccgccaagcgcccauucgugaaacugaaugucgaaacugacacagcagagauacgauuaaugugcaccgagacguaucuggauacccccagaccuaacgacggcucuaucacaggcccaugugaauccgauggggacaagggaagcgguggcauuaaagggggauuugugcaucagaggauggcuucgaagaucggccggugguacucucguacuauguccaaaaccaagcgcauggguauggggcucuauguaaaguacgacggcgaucccuggacagacucagaggcccuugcucugaguggaguuauggugagcauggaggaaccgggcugguacuccuucggguuugaaauaaaagauaagaaaugcgacgucccuuguauuggaaucgagauggugcacgaugguggcaagacuaccuggcauucugccgcaacagccaucuauugcuugauggggagcggacagcuacugugggacaccgugacuggcgucgauauggcucucuga

SEQ ID NO: 151944 - RNA, 1401 nt, Artificial Sequence; identical to SEQ ID NO: 151856
  derived and/or modified sequence opt3 from neuraminidase__InfluenzaB__AGZ60176

SEQ ID NO: 151945 - RNA, 1401 nt, Artificial Sequence; identical to SEQ ID NO: 150833
  derived and/or modified sequence opt3 from neuraminidase__InfluenzaB__AGZ60187

SEQ ID NO: 151946 - RNA, 1401 nt, Artificial Sequence; identical to SEQ ID NO: 150833
  derived and/or modified sequence opt3 from neuraminidase__InfluenzaB__AGZ60198

SEQ ID NO: 151947 - RNA, 1401 nt, Artificial Sequence; identical to SEQ ID NO: 150833
  derived and/or modified sequence opt3 from neuraminidase__InfluenzaB__AGZ60210

SEQ ID NO: 151948 - RNA, 1401 nt, Artificial Sequence
  derived and/or modified sequence opt3 from neuraminidase__InfluenzaB__AGZ60221
augcugcccaccacaauccagacucucacgcuuuuccugaccagcggcgggguguuguuaucccuguacgucucugccucacuaaguuaucuccuguacagcgacauucuucugaaguuuuccagaacagagauaacugcuccuaucaugccauuggauugcgcaaacgccucuaauguucaagcggugaacaggucggcuaccaaaggaguaacacuccugcugccggaacccgaguggaccuauccucggcucucauguccagguagcacuuuccagaaggccuuacugauuaguccccaccgcuuuggcgaaacaaaaggaaauuccgcaccucuuaucauucgagagccauucaucgccugcgggcccaaggaauguaaacauuuugcuuugacccacuacgcagcccagccuggcgguuauuacaacgggacgcgugaggacagaaauaagcugaggcaucuaauaucugugaagcucggaaaaaucccaacugucgagaacagcauuuuccacauggcugccugguccggcucagcgugccaugauggccgggaauggaccuauaucgggguggacggaccggauaguaaugcacugcuuaagauuaaauacggugaggccuacacagacacuuaucacagcuacgcuaagaacauccugcgcacccaggaaucugccuguaauugcauaggcggggauuguuauuugaugauuacagacggacccgcauccggcaucucagagugcagauuucucaaaauuagggagggucggaucaucaaggaaauuuucccuaccgggcgcguuaagcacacggaggaauguacuugcggauuugcuagcaacaaaacaauagagugugccugccgagauaauaguuacaccgcgaagagaccauucgugaaacugaacgucgaaacugacacagccgagaucagguuaaugugcaccgagacguaucuggauacaccccggccuaaugacggcucuauuaccggcccaugugaauccaacggggauaagggaagcgguggcaucaaagggggauuugugcaucaacguauggcaucgaagauaggccgcugguacucuagaacuauguccaaaaccaagaggauggguauggggcucuauguaaaguacgacggcgaccccuggacagauucagaggcucuugcccugaguggaguuauggugagcauggaggaaccgggcugguacuccuucggguuugaaauuaaagacaagaaaugcgaugucccuuguaucggaaucgagauggugcacgacgguggcaagacuaccuggcauucugcugccacagcaauuuauugcuugauggggagcggacagcuacugugggauaccgugacuggcgucaauaugacgcucuga

SEQ ID NO: 151949 - RNA, 1401 nt, Artificial Sequence
  derived and/or modified sequence opt3 from neuraminidase__InfluenzaB__AGZ60272
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccgaagcccgaauggaccuauccuaggcucagcuguccagguaguacauuccagaaagcauuacugauuucuccccaccgguuuggcgagaccaagggaaauuccgccccucuuaucauucgcgaaccauucaucgcuugcgggcccacugaguguaaacauuuugcauugacacacuacgccgcucagccuggcgguuauuacaacgggacccgagaagaccguaauaagcugagacaucuaauaagcgugaagcucggaaaaaucccaacggucgagaacuccauuuuccacauggccgcguggucaggcagugcaugccaugauggcaaggaguggacuuauaucgggguggacggaccggauagcaaugcccugcuuaaaauuaaguacggugaggcuuacaccgacacauaucacucuuacgccaaaaacauccugaggacucaagaauccgcauguaauugcauaggcggggauuguuauuugaugauuaccgacggacccgcuucaggcaucagcgaaugccgguuucucaagauucgcgaggguagaaucaucaaggagauuuucccuacagggaggguuaaacacaccgaagaguguacgugcggauuugccaguaacaagacuauagaaugugcgugccgggauaauucuuacacagccaaacgcccauucgugaagcugaacgucgagaccgacacugcagaaauccgauuaaugugcacagagaccuaucuggauacgcccagaccuaaugacggcuccauuaccggcccaugugagagcgauggggacaaaggaucggguggcaucaaagggggauuugugcaucagaggauggcuucuaagauaggccggugguacucccguacaaugucaaagacuaagcgcauggguauggggcucuauguaaaauacgacggcgaucccuggaccgacagugaagcccuugcucugagcggaguuaugguguccauggaggaaccgggcugguacucuuucggguuugagauuaaggauaaaaagugcgacgucccuuguaucggaaucgaaauggugcacgaugguggcaaaacaacuuggcauagcgccgcaaccgccauuuauugcuugauggggucaggacagcuacugugggacacagugaccggcgucgauauggcucucuga

SEQ ID NO: 151950 - RNA, 1398 nt, Artificial Sequence
  derived and/or modified sequence opt3 from neuraminidase__InfluenzaB__AHL91182
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccaugucucucgauugcgcaaacgccucgaauguucaagcggugaaccacucagcuacaaaggagaugaaauuccugccgcccgaaccugaguggacuuauccaagacugagcugucagggaaguaccuuucagaaggcccucuuaauuucuccccauagguucggugaagcaaaaggcaauuccgccccucugaucauucgggagccauuuaucgcuugcgggcccaaggaauguaagcacuucgcacuuacacauuacgccgcucagccuggaggcuauuacaacgguacccgcgaggaccgaaauaaauugcgucaccugauaagcguaaaccuagggaagaucccaacuguggaaaauuccauuuuucauauggccgcguggucaggaagugcaugccacgauggcagagaauggacauauaucggcgucgacgggccggauagcaacgcccucauuaaaaucaaguacggagaggcuuacaccgacacguaucacucuuacgccaauaacauacugaggacucaagaauccgcauguaauugcauugguggcgauuguuaucuuaugaucaccgacgggucagcuagcggaauuaguaaaugccgguuccugaagauccgcgagggcagaaucauuaaggagauauuucccacagguaggguggaacauacugaggaauguaccugcggguucgccucuaacaaaacaaucgagugugcgugccgggauaauuccuacaccgccaagcgcccuuuuguuaaauugaacguggaaacggacacugcagagauucgacucaugugcacagagaccuaucuggauacuccaagacccgacgauggaagcaucacaggcccuugugaaucgaauggcgacaaggggaggggaggugucaaaggcggguucgugcaccagcggauggcuucuaagauaggacguugguacucccgcaccaugucaaaaacgaagagaaugggcauggaguuauauguaaaguacgacggugauccauggaccgacagugaugcccuggcucccagcgggguuaugguguccauggaggagccgggcugguacucuuuuggauucgaaauuaaagacaagaaaugcgaugucccuuguaucggcaucgagauggugcaugacgggggaaagaggacauggcacagcgccgcaacugccauuuauugccucauggguucaggccagcuucugugggauaccgugacaggggucgacauggcuuuguga

SEQ ID NO: 151951 - RNA, 1398 nt, Artificial Sequence
  derived and/or modified sequence opt3 from neuraminidase__InfluenzaB__AHL91193
augcugcccagcaccauccagacacucacucuuuuccugacguccggcgggguguuguuaucucuguacgucucagcccuacucaguuaucugcuuuacagcgacauucuguugaaguuuuccccuaaaauaaucgcuccaaccaugucucucgauugcgcaaacgccucgaauguucaagcggugaaccacucagcuacaaaggagaugaaauuccugccgagcgaacccgaguggacuuauccuagacugaguugucagggauccaccuuucagaaggcccucuuaauuucuccacauagguucggugaagcaaaaggcaauagcgcuccccugaucauucgggagccuuuuaucgccugcgggccaaaggaauguaagcacuucgcacuuacacauuacgccgcucagcccggaggcuauuacaacgguacccgcgaggaccgaaauaaauugcgucaccugauauccguaaaccuagggaagaucccuacuguggaaaauucaauuuuucauauggccgcguggaguggaagcgcaugccacgauggcagagaauggacauauaucggcgucgacgggccagauucuaacgcccucauuaaaaucaaguacggagaggcuuacaccgacacguaucacuccuacgccaauaacauacugaggacucaagaaucagcauguaauugcauugguggcgauuguuaucuuaugaucaccgacgggagcgcuaguggaauuucuaaaugccgguuccugaagauccgcgagggcagaaucauuaaggagauauuuccgacagguaggguggaacauacugaggaauguaccugcggguucgccuccaacaaaacaaucgagugugcgugccgggauaauagcuacaccgccaagcgccccuuuguuaaauugaacguggaaacggacacugcagagauucgacucaugugcacagagaccuaucuggauacuccuagaccagacgauggaucgaucacaggccccugugaaucuaauggcgacaaggggaggggaggugucaaaggcggguucgugcaccagcggauggcuuccaagauaggacguugguacucacgcaccaugaguaaaacgaagagaaugggcauggaguuauauguaaaguacgacggugauccuuggaccgacagcgaugcccuggcuccauccgggguuauggugucuauggaggagcccggcugguacagcuuuggauucgaaauuaaagacaagaaaugcgaugucccguguaucggcaucgagauggugcaugacgggggaaagaggacauggcacucagccgcaacugccauuuauugccucauggguaguggccagcuucugugggauaccgugacaggggucgacauggcuuuguga

SEQ ID NO: 151952 - RNA, 1398 nt, Artificial Sequence
  derived and/or modified sequence opt3 from neuraminidase__InfluenzaB__AHL91204
augcugcccagcaccauccagacacucacucuuuuccugacguccggcgggguguuguuaucucuguacgucucagcccuacucaguuaucugcuuuacagcgacguucuguugaaguuuuccccuaaaauuauagcuccaaccaugucucucgauugcgcaaacgccucgaaugugcaagcgguaaaccacucagcuacagaggaaaugacuuuccugcugccggagcccgaauggaccuauccuagacucagcugucagggaaguacauuucagaaggccuuacugaucuccccacauagguucggugaggcaaaaggcaauucugcuccccuuauuauccgggaaccuuuuauugcuugcgggccaaaggaguguaaacacuucgcauugacccauuacgccgcucagcccggaggcuauuacaacgguacucgcgaggaccgaaauaagcugcgucaccuaaucagcgugaaccucgggaagauaccuacagucgaaaauuccaucuuucauauggccgcguggucaggaagugcaugccacgauggcagagaguggaccuauauuggcguggacgggccagauagcaacgcccugaucaaaauuaaguacggagaagccuacacggacacuuaucacucuuacgccaauaacauccuuaggacccaagaguccgcauguaauugcauagguggcgauuguuaucugaugauuacagacgggucagcuagcggaaucaguaaaugccgguucuugaagauucgcgagggcagaaucaucaaagaaauuuuuccgacugguaggguugagcauaccgaagaguguacaugcggguucgccucuaacaagaccauagaaugugcgugccgggauaauaucuacacggccaagcgccccuuugugaaacucaacgucgagacugacacagcagagauucgacugaugugcaccgaaacuuauuuagauacaccuagaccagacgauggauccaucaccggccccugugagagcaauggcgacaaggggcacggagguauaaaaggcggguucgugcaucagaggauggcuucgaagauuggacggugguacucucguacgauguccaaaaccaagcgcaugggcauggaacuguauguaaaauacgacggugauccuuggacagacucagaugcccucgcuccaagugggguuauggugagcauggaggaacccggcugguacuccuuuggauucgagaucaaggacaagaaaugcgaugucccguguaucggcauugagauggugcacgacgggggaaagaaaacuuggcacucugccgcaaccgccaucuauugccuuauggguagcggccagcuguugugggauacagugacuggggucgacauggcucuauga

SEQ ID NO: 151953 - RNA, 1398 nt, Artificial Sequence
  derived and/or modified sequence opt3 from neuraminidase__InfluenzaB__AHL91215
augcugcccagcaccauccagacacucacucuuuuccugacguccggcgggguguuguuaucucuguacgucucaacccuacucaguuaucugcuuuacagcgacauucuguugaaguuuuccccuaaaauaaucgccccaacaacuucucucgauugcgcuaacgcaucgaauguucaagccgugaaccacucagcgaccaaggagaugaaauuccugccgacagaacccgaguggaccuauccuagacugagcugucagggaaguacuuuucagaaggcucucuuaauuuccccacauagguucggugaagccaaaggcaauucugcaccccugaucauucgggagccuuuuaucgccugcgggccaaaggaauguaagcacuucgcucuuacacauuacgcagcccagcccggaggcuauuacaacgguacccgcgaggaccgaaauaaauugcgucaccugauaagcguaaaccuagggaagaucccuacgguggaaaauuccauuuuucauauggcugccuggucaggaagugcgugccacgauggcagagaauggacuuauaucggcgucgacgggccagauagcaacgcacucauuaaaaucaaguacggagaggccuacaccgacacauaucacucuuacgcuaauaacauacugaggacucaagaauccgccuguaauugcauugguggcgauuguuaucuuaugaucaccgacgggucagcaagcggaauuaguaaaugccgguuccugaagauccgcgagggcagaaucauuaaggagauauuuccgacagguaggguggaacauaccgaggaauguacgugcggguucgcuucuaacaaaacuaucgagugugccugccgggauaauuccuacacagcgaagcgccccuuuguuaaauugaacguggaaaccgacacugccgagauucgacucaugugcacagagaccuaucuggauacgccuagaccagacgauggaagcaucaccggccccugugaaucgaauggcgacaaggggucuggaggugucaaaggcggguucgugcaccagaggaugacauccaagauaggacggugguacucacguacuaugaguaaaaccaagcgcaugggcauggaguuauauguaaaguacgacggugauccuuggacagacagcgaugcacuggcuccauccgggguuauggugucuauggaggagcccggcugguacagcuuuggauucgaaauuaaagacaagaaaugcgaugucccguguaucggcaucgagauggugcaugacgggggaaagagaacuuggcacucagccgcuaccgccauuuauugccucauggguaguggccagcuucugugggauacagugaccggggucgacauggcauuguga

SEQ ID NO: 151954 - RNA, 1401 nt, Artificial Sequence; identical to SEQ ID NO: 150725
  derived and/or modified sequence opt3 from neuraminidase__InfluenzaB__AHL91226

SEQ ID NO: 151955 - RNA, 1401 nt, Artificial Sequence; identical to SEQ ID NO: 150726
  derived and/or modified sequence opt3 from neuraminidase__InfluenzaB__AHL91237

SEQ ID NO: 151956 - RNA, 1401 nt, Artificial Sequence; identical to SEQ ID NO: 150726
  derived and/or modified sequence opt3 from neuraminidase__InfluenzaB__AHL91248

SEQ ID NO: 151957 - RNA, 1401 nt, Artificial Sequence; identical to SEQ ID NO: 150725
  derived and/or modified sequence opt3 from neuraminidase__InfluenzaB__AHL91259

SEQ ID NO: 151958 - RNA, 1401 nt, Artificial Sequence; identical to SEQ ID NO: 150725
  derived and/or modified sequence opt3 from neuraminidase__InfluenzaB__AHL91270

SEQ ID NO: 151959 - RNA, 1398 nt, Artificial Sequence; identical to SEQ ID NO: 150697
  derived and/or modified sequence opt3 from neuraminidase__InfluenzaB__AHL91281

SEQ ID NO: 151960 - RNA, 1401 nt, Artificial Sequence
  derived and/or modified sequence opt3 from neuraminidase__InfluenzaB__AHL91303
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcagggaauggaccuauauugggguggacggacccgauagcaaugcacugcuuaagaucaaauacggugaggccuacacagacacuuaucacucuuacgcuaacaauauucugcggacccaggaauccgccuguaacugcaucggcggggauuguuauuugaugauaacagacggaucagcaagcggcauuaaugagugccgcuuucucaagaucagagaggguaggauuaucaaagaaaucuucccuaccgggcggguugagcacacggaagaguguacuugcggauuugcuaguaacaagacaauugaaugugccugccgcgauaauucuuacaccgcgaagcgaccauucgugaaacugaacgucgagacugacacagccgagauaagauuaaugugcaccgaaacguaucuggauacccccaggccugacgauggcuccaucacaggcccaugugagagcaauggggacaagggaucggguggcauuaaagggggauuugugcaucaacggauggcaucuaagaucggccguugguacucccgcacuaugucaaaaaccagaaggauggguauggggcucuauguaaaguacgacggcgaucccuggacagacagugaugcucuugcccugagcggaguuaugguguccauggaggaaccgggcugguacucuuucggguuugaaauaaaagacaagaagugcgaugucccuuguauuggaaucgagauggugcacgacgguggcaaaaagacuuggcauagcgcugccaccgcaaucuauugcuugauggggucaggacagcuacugugggauacagugaccggcgucgacauggcccucuga

SEQ ID NO: 151961 - RNA, 1401 nt, Artificial Sequence; identical to SEQ ID NO: 150726
  derived and/or modified sequence opt3 from neuraminidase__InfluenzaB__AHL91314

SEQ ID NO: 151962 - RNA, 1401 nt, Artificial Sequence; identical to SEQ ID NO: 150726
  derived and/or modified sequence opt3 from neuraminidase__InfluenzaB__AHL91325

SEQ ID NO: 151963 - RNA, 1401 nt, Artificial Sequence
  derived and/or modified sequence opt3 from neuraminidase__InfluenzaB__AHL91347
augcugcccagcaccauccagacacucacucuuuuccugacguccggcgggguguuguuaucucuguacgucucagccagucuaagcuaucuccuguacuccgacguucuucugaaguuuucuccuaccgagauuacagcuccaacuaugccguuggauugcgcaaacgccucgaaugugcaagcgguaaacagaucagcuaccaaaggagugacacuccugcugcccgaaccugaguggaccuauccaaggcucagcugucccgguaguacuuuccagaaggccuuacugauauccccucaccgguuuggcgaaacaaaaggaaauucugcaccacuuaucauucgcgagcccuucaucgccugcgggccuaaggaauguaaacauuuugcuuugacccacuacgcagcccagccaggcgguuauuacaacgggacgcgagaggaccguaauaagcugagacaucuaauuagcgucaagcucggaaaaaucccgacuguggagaacuccauauuccacauggcugccuggucaggcagugcgugccaugauggcagggaauggaccuauaucgggguugacggacccgauagcaaugcacugcuuaagauuaaauacggugaggccuacacagacacuuaucacucuuacgcuaacaauauccugcggacccaggaauccgccuguaacugcauuggcggggauuguuauuugaugaucacagacggaucagcaagcggcauaagugagugccgcuuucucaagauuagagaggguaggaucgugaaagaaauuuucccuaccgggcgggucgagcacacggaagaguguacuugcggauuugcuucuaauaagacaaucgaaugugccugccgcgauaacuccuacaccgcgaagcgaccauucgugaaacugaauguagagacugacacagccgagaucagauuaaugugcaccgaaacguaucuggauacccccaggccugaggacggcagcauuacaggcccaugugaaucgaacggggauaagggaucugguggcauaaaagggggauuuguucaucaacggauggcauccaagaucggccguugguacucacgcacuaugaguaaaaccaagagaauggguauggggcucuaugugaaauacgacggcgaccccuggacagauagcgacgcucuugcccuguccggagucauggugucuauggaggaaccgggcugguacagcuucggguuugagauuaaggauaagaaaugcgacgugccuuguaucggaauagagaugguccacgaugguggcaaggaaacuuggcauucagcugccaccgcaauuuauugcuugauggggaguggacagcuacugugggacacaguuaccggcguggauauggcccucuga

SEQ ID NO: 151964 - RNA, 1401 nt, Artificial Sequence; identical to SEQ ID NO: 151963
  derived and/or modified sequence opt3 from neuraminidase__InfluenzaB__AHL91358

SEQ ID NO: 151965 - RNA, 1401 nt, Artificial Sequence; identical to SEQ ID NO: 150701
  derived and/or modified sequence opt3 from neuraminidase__InfluenzaB__AHL91369

SEQ ID NO: 151966 - RNA, 1401 nt, Artificial Sequence; identical to SEQ ID NO: 150701
  derived and/or modified sequence opt3 from neuraminidase__InfluenzaB__AHL91380

SEQ ID NO: 151967 - RNA, 1401 nt, Artificial Sequence
  derived and/or modified sequence opt3 from neuraminidase__InfluenzaB__AHL91391
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguugaacugcgcaaaugccucgaacguucaagcggugaauagaucagcuacuaagggaguaacccucccccugccugaaccagaguggacauaucccaggcugagcuguccugguaguaccuuccagaaagcccucuuaaucuccccacaccgguuuggcgaaacuaaggggaacucugcaccccugauuauccgcgagccuuucauugccugcggaccaaaagaauguaagcauuuugcucuuacacacuacgcagcccagccgggcgguuauuacaaugggacccgagaggaucguaacaaguugagacaucugaucagcgugaaacuaggaaagauacccacggucgaaaauuccaucuuccacauggcugccuggucaggcagugcgugccaugacggcagggaauggacuuauauugggguggauggaccugacaacaaugcacuccugaaaaucaaguacggugaggccuacaccgauacauaucacagcuacgcuaacaauauucuucggacucaggaaucugccuguaacugcaucggcggggacuguuaucugaugauaaccgauggauccgcaucaggcauuagcgagugccgcuuuuugaaaaucagagaggguaggauuaucaaggaaaucuucccaacagggcggguugagcacaccgaagaguguacgugcggauuugcuaguaauaagacuauugaaugugccugccgcgacaacucuuacacagcgaaacgacccuucgugaagcucaaugucgagaccgauacugccgagauaagacugaugugcacagaaaccuauuuagacacgccuaggccagaugacggcuccaucaccggccccugugagagcaacggggauaaaggaucggguggcauuaaagggggauuugugcaucaacggauggcaucuaagaucggccguugguacucccgcacaaugucaaagacuaaaagaauggguauggggcuguauguaaaguacgacggcgacccguggauagauagugacgcucucacccuuagcggaguuaugguguccauggaggagccuggcugguacucuuucggguuugaaauuaaggauaaaaagugcgacguccccuguaucggaaucgagauggugcacgaugguggcaaaacaacuuggcauagcgccgcuaccgccauuuauugccugauggggucaggacaguugcuaugggacacagugaccggcgucgauauggcacuguga

SEQ ID NO: 151968 - RNA, 1401 nt, Artificial Sequence
  derived and/or modified sequence opt3 from neuraminidase__InfluenzaB__AHL91413
augcugcccagcaccauccagacacucacucuuuuccugacguccggcgggguguuguuaucucuguacgucucagccagucuaagcuaucuccuguacuccgacauucuucugaaguuuaccccuacagagauaacugcuccaaccaugccguuggauugcgcaaacgccucuaauguucaagcggugaaccucucggcuacaaaaggaguaacccugcugcuccccgaaccugaguggacuuauccaagauuaucaugucccgguagcacauuccagaaggcccugcuuaucaguccucacagguuuggcgaaaccaaaggcaauuccgcaccauugauuauccgggagcccuucauugccugcggaccuaaggaauguaaacauuuugcucugacgcacuacgcagcccagccaggcgguuauuacaacgggacucgcgaggaccgaaauaagcuacgucaucucaucucugugaagcugggaaaaauaccgaccgucgagaacagcaucuuccacauggcugccugguccggcucagcgugccaugauggcaaggaauggacauauauugggguggacggacccgauaguaaugcacuucugaaaaucaaguacggugaggccuacacugacaccuaucacagcuacgcuaacaauauuuugagaacacaggaaucugccuguaacugcaucggcgggaauuguuaucucaugauaaccgauggauccgcaucaggcauuagcgagugcagguuucugaaaauccgggagggucgcauuaucaaggaaaucuucccuacggggagaguuaagcacacugaggaauguacaugcggauuugcuaguaacaaaaccauugagugugccugcagggacaauucuuacacugcgaagcggccauucgugaaauuaaacgucgaaacagauaccgccgagauacgccugaugugcacggagaccuaucucgacacaccccgaccugaugacggcuccaucacuggcccaugugaaagcaaugggaacaagggaucggguggcauuaaagggggauuugugcaucaaagaauggcaucuaagaucgggaggugguacucccggaccaugucaaaaacaaagcguauggguauggggcuuuauguaaaguacgauggcgaccccuggacugacagugaugcucuggccuugagcggaguuaugguguccauggaggaaccgggcugguacucuuucggguuugagauaaaagacaagaaaugcgaugucccuuguauuggaaucgaaauggugcacgacgguggcaaggagaccuggcauagcgcugccacagcaaucuauugccuaauggggucaggacagcugcucugggauaccgugacuggcgucgacauggcccuguga

SEQ ID NO: 151969 - RNA, 1401 nt, Artificial Sequence
  derived and/or modified sequence opt3 from neuraminidase__InfluenzaB__AHL91446
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaaugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcguaaagcucggaaaaauaccgacuguggagaacuccaucuuccacauggcugccuggucaggcagugcgugccaugauggcaaggaauggaccuauauuggggucgacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguggagcacacggaagaguguacuugcggauuugcuucuaacaagacaauugaaugugccugccgggacaauuccuacaccgcgaaacgcccauucguuaagcugaacguggagacugauacagccgagauacgauuaaugugcaccgaaacguaucuggacacccccagaccugaugacggcagcaucacaggcccaugugagucgaaugggggaaaagguucuggcgggauuaagggaggcuuuguccaucaaaggauggaauccaaaaucggucggugguacucacguacuaugaguaagaccaaacgcauggggaugggccucuaugugaaguacgauggagaccccuggacagacagcgaugcacuugcucuguccggcguaaugguuucuauggaggaaccggggugguacagcuucggauuugagauaaaggacaaagagugcgaugugccuuguauugguaucgaaaugguccacgacggcgggaaggagacuuggcauucagccgcuaccgccaucuauugcuugaugggaaguggccagcuacugugggauacagugaccggugugaacauggcacucuga

SEQ ID NO: 151970 - RNA, 1401 nt, Artificial Sequence
  derived and/or modified sequence opt3 from neuraminidase__InfluenzaB__AHL91457
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaaucaugccguuggauugcgcaaacgccucgaauguucaagcggugaacagaucagcuacuaaaggaguaacccuccugcugcccgaaccugaguggacauauccaaggcucagcugucccgguaguaccuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauaauaacgcacugcuuaaaauuaaguacggcgaagccuacaccgacacauaucacagcuacgcuaauaacacucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggaaacaaggguucgggcgggauuaaaggaggcuuugugcaucaaaggauggcaucuaagaucggucggugguacucccguacuaugucaaaaaccaagcgcauggggaugggccucuauguaaaguacgauggagaccccuggacagacagugaugcucuugcccugagcggcguuaugguguccauggaggaaccggggugguacucuuucggauuugaaauaaaagacaagaaaugcgaugucccuuguauugguaucgagauggugcacgacggcgggaaggaaacuuggcauagcgcugccaccgcaaucuauugcuugaugggaucaggccagcuacugugggauacagugaccggugucgacauggcccucuga

SEQ ID NO: 151971 - RNA, 1401 nt, Artificial Sequence
  derived and/or modified sequence opt3 from neuraminidase__InfluenzaB__AHL91468
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguuaagcacacggaggaauguacuugcggauuugcuucuaacaaaacaauugagugugccugccgggacaauuccuacaccgcgaagcgcccauucgugaaacugaacgucgaaacugauacagccgagauacgauuaaugugcaccgagacguaucuggacacccccagaccugaugacggcagcaucacaggcccaugugaaucgaauggggauaagggaucugguggcauuaaagggggauuugugcaucaaaggauggcauccaagaucggccggugguacucacguacuaugaguaaaaccaagcgcauggguauggggcucuauguaaaguacgacggcgaccccuggacagauagcgacgcucuugcccuguccggaguuauggugucugucggcgagccggggugguacagcuucggauuugaaauaaaagauaagaaaugcgacgugccuuguauugguaucgagauggugcacgauggcgggaaggaaacuuggcauucagcugccaccgcaaucuauugcuugaugggaaguggccagcuacugugggacacagucaccgguguugauauggcccucuga

SEQ ID NO: 151972 - RNA, 1401 nt, Artificial Sequence
  derived and/or modified sequence opt3 from neuraminidase__InfluenzaB__AHL91479
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccgucggauugcgcaaacgccucaaauguucaagcggugaacagaagcgcuaccaaaggaguaacauugcuccugcccgaaccugaguggaccuauccaaggcugaguugucccgguuccacuuuccagaaggcccucuuaaucucuccucaccgguuuggcgaaacaaaagggaauagcgcaccacugauuauccgcgagcccuucauugccugcggaccuaaggaauguaaacauuuugcucuuacccacuacgcagcccagccaggcgguuauuacaacgggacgcgaggagaccguaauaaguugagacaucugaucuccgugaagcuaggcaaaauaccgacugucgagaacucaaucuuccacauggcugccuggaguggcagcgcgugccaugaugggaaggaguggaccuauauuggaguggacggucccgauucuaaugcacuccugaaaaucaaguacggcgaagccuacacagacacuuaucacuccuacgcuaacaauauucuuaggacccaggagucagccuguaacugcaucgggggaaauuguuaucugaugauaacagauggcagcgcaagugguauuucugaaugccgguuuuugaaaauccgcgaggggagaauuaucaaggagaucuucccuaccggaaggguuaagcacacggaagaguguacuugcggcuuugcuuccaacaaaacaauugaaugugccugccgggacaauagcuacaccgcgaagcgcccauucgugaaacucaacgucgagacugauacagccgaaauacgacugaugugcaccgagacguauuuagacacccccagaccugaugacggcucgaucacagggccaugugagucuaauggagauaaggguuccggcgggauuaaaggaggcuuugugcaucaaaggauggcaucaaagaucggucggugguacagucguacuaugagcaaaaccaagcgcauggggaugggccuguauguaaaguacgacggagaccccuggacagauuccgacgcucucgcccuuucuggcguuauggugagcauggaggaaccggggugguacucauucggauuugaaauaaaagauaagaaaugcgacgucccuuguauugguaucgagauggugcacgauggcgggaaggaaacuuggcauagugcugccaccgcaaucuauugccugaugggauccggccaguugcuaugggacacagugaccggugucgauauggcccuguga

SEQ ID NO: 151973 - RNA, 1401 nt, Artificial Sequence
  derived and/or modified sequence opt3 from neuraminidase__InfluenzaB__AHL91501
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaaugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgagaggaccguaauaagcugagacaucuaaucagcguaaagcucggaaaaauaccgacuguggagaacuccaucuuccacauggcugccuggucaggcagugcgugccaugauggcaaggaauggaccuauauuggggucgacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguggagcacacggaagaguguacuugcggauuugcuucuaacaagacaauugaaugugccugccgggacaauuccuacaccgcgaaacgcccauucguuaagcugaacguggagacugauacagccgagauacgauuaaugugcaccgaaacguaucuggacacccccagaccugaugacggcagcaucacaggcccaugugagucgaaugggggaaaagguucuggcgggauuaagggaggcuuuguccaucaaaggauggaauccaaaaucggucggugguacucacguacuaugaguaagaccaaacgcauggggaugggccucuaugugaaguacgauggagaccccuggacagacagcgaugcacuugcucuguccggcguaaugguuucuauggaggaaccggggugguacagcuucggauuugagauaaaggacaaaaagugcgaugugccuuguauugguaucgagaugguccacgacggcgggaaagaaacuuggcauucagccgcuaccgccaucuauugcuugaugggaaguggccagcuacugugggauacagugaccggugugaacauggcacucuga

SEQ ID NO: 151974 - RNA, 1401 nt, Artificial Sequence
  derived and/or modified sequence opt3 from neuraminidase__InfluenzaB__AHL91512
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguaucuuccagaaggccuuacugauuuccccucaccgguuuggcgaaacuaaaggaaauucugcaccacuuaucauucgcgagcccuucaucgccugcgggccuaaggaauguaaacauuuugcuuugacacacuacgcagcccagccaggcgguuauuacaacgggacccgaggagaccguaauaagcugagacaucuaauaagcgugaagcucggcaaaaucccgacggucgagaacuccauuuuccacauggcugccuggucaggcagugcgugccaugaugggaaggaguggacuuauaucggaguggacggucccgauagcaaugcacugcuuaaaauuaaguacggcgaagccuacaccgacacauaucacucuuacgcuaacaauauccugaggacucaggaguccgccuguaacugcauagggggaaauuguuauuugaugauuaccgauggcucagcaagcgguaucagugaaugccgguuucucaaaauucgcgaggggagaaucaucaaggagauuuucccuacaggaaggguuaagcacaccgaagaguguacgugcggcuuugcuucuaacaaaacuauagaaugugccugccgggacaauuccuacacagcgaagcgcccauucgugaaacugaacgucgagaccgauacugccgaaauccgauuaaugugcacagagaccuaucuggacacgcccagaccugaugacggcagcauuaccgggccaugugagucgaauggagauaaggguucuggcgggaucaaaggaggcuuugugcaucaaaggauggcauccaagauaggucggugguacucacguacaaugaguaaaacuaagcgcauggggaugggccucuauguaaaguacgacggagaccccuggaccgauagcgacgcucuugcccuguccggcguuauggugucuauggaggaaccggggugguacagcuucggauuugaaauuaaagauaagaaaugcgacgucccuuguaucgguaucgagauggugcacgauggcgggaaggaaacauggcauucagcugccacugcaauuuauugcuugaugggaaguggccagcuacugugggacaccgugacaggugucgauauggcccucuga

SEQ ID NO: 151975 - RNA, 1401 nt, Artificial Sequence
  derived and/or modified sequence opt3 from neuraminidase__InfluenzaB__AHL91523
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguauuagcgaaugccgguuucucaaaauccgcgaggggagaauuaucaaggagaucuucccuaccggaaggguuaagcacacggaagaguguacuugcggcuuugcuaguaauaaaacaauugaaugugccugccgggacaacucuuacaccgcgaagcgcccauucgugaaacugaaugucgagacugauacagccgaaauacgauuaaugugcaccgagacguaucuggacacccccagaccugaugacggcuccaucacagggccaugugagagcaacggagauaaggguucgggcgggauuaaaggaggcuuugugcaucaaaggauggcaucuaagaucggucggugguacucccguacuaugucaaaaaccaagcgcauggggaugggccucuauguaaaguacgacggagaccccuggacagauagugacgcucuugcccugagcggcguuaugguguccauggaggaaccggggugguacucuuucggauuugaaauaaaagauaagaaaugcgacgucccuuguauugguaucgagauggugcacgauggcgggaaggaaacuuggcauagcgcugccaccgcaaucuauugcuugaugggaucaggccagcuacugugggacacagugaccggugucgauauggcccucuga

SEQ ID NO: 151976 - RNA, 1401 nt, Artificial Sequence; identical to SEQ ID NO: 151973
  derived and/or modified sequence opt3 from neuraminidase__InfluenzaB__AHL91534

SEQ ID NO: 151977 - RNA, 1401 nt, Artificial Sequence
  derived and/or modified sequence opt3 from neuraminidase__InfluenzaB__AHL91545
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauagcaaugcacugcuuaaaaucaaguacggcgaagccuacacagacacuuaucacucuuacgcuaacaauauucugaggacccaggaguccgccuguaacugcaucgggggaaauuguuauuugaugauaacagauggcucagcaagcgguauuagugaaugccgguuucucaaaauccgcgaggggagaauuaucaaggagaucuucccuaccggaaggguuaagcacacggaagaguguacuugcggcuuugcuucuaacaaaacaauugaaugugccugccgggacaauuccuacaccgcgaagcgcccauucgugaaacugaacgucgagacugauacagccgaaauacgauuaaugugcaccgagacguaucuggacacccccagaccugaugacggcagcaucacagggccaugugagucgaauggagauaaggguucuggcgggauuaaaggaggcuuugugcaucaaaggaugacuuccaagaucggucggugguacucacguaccaugaguaaaacaaagcgcauggggaugggccucuauguaaaguacgacggagaccccuggacugauagcgacgcacuugcucuguccggcguuauggugucuauggaggaaccggggugguacagcuucggauuugaaauaaaagauaagaaaugcgacgucccuuguauugguaucgagauggugcacgauggcgggaagggaaccuggcauucagccgcuacagccaucuauugcuugaugggcaguggucagcuacugugggacaccgugacuggggucgauauggcacucuga

SEQ ID NO: 151978 - RNA, 1401 nt, Artificial Sequence; identical to SEQ ID NO: 151973
  derived and/or modified sequence opt3 from neuraminidase__InfluenzaB__AHL91556

SEQ ID NO: 151979 - RNA, 1401 nt, Artificial Sequence; identical to SEQ ID NO: 151973
  derived and/or modified sequence opt3 from neuraminidase__InfluenzaB__AHL91578

SEQ ID NO: 151980 - RNA, 1401 nt, Artificial Sequence; identical to SEQ ID NO: 150901
  derived and/or modified sequence opt3 from neuraminidase__InfluenzaB__AHL91589

SEQ ID NO: 151981 - RNA, 1401 nt, Artificial Sequence
  derived and/or modified sequence opt3 from neuraminidase__InfluenzaB__AHL91600
augcugcccagcaccauccagacacucacucuuuuccugacgaccggcgggguguuguuaucccuguacgucucugccucacuaaguuaucuccuguacagcgacauucuucugaaguuuuccccuacagagauaacugcuccaaccaugccguuggauugcgcaaacgccucuaauguucaagcggugaacagaucggcuacaaaaggaguaaccuuccuccugcccgaaccugaguggacuuauccaaggcugucaugucccgguagcacauuucagaaggcccucuuaaucaguccucaccgguucggcgaaaccaaaggaaauuccgcaccacugauuauccgcgagcccuuuauugccugcgggccuaaggaauguaaacauuucgcucuuacgcacuacgcagcccagccaggcgguuauuacaacgggacucgaggagaccguaauaaguugagacaucugaucucugugaagcuaggcaaaauaccgaccgucgagaacagcaucuuucacauggcugccugguccggcucagcgugccaugaugggaaggaguggacauauauuggaguggacggucccgauaguaaugcacuccugaaaaucaaguacggcgaagccuacacugacaccuaucacagcuacgcuaacaauauucuuaggacacaggagucugccuguaacugcaucgggggaaauuguuaucugaugauaaccgauggcuccgcaucagguauuagcgaaugccgguucuugaaaauccgcgaggggagaauuaucaaggagaucuuuccuacgggaaggguuaagcacacugaagaguguacaugcggcuucgcuaguaacaaaaccauugaaugugccugccgggacaauucuuacacugcgaagcgcccauuugugaaacucaacgucgagacagauaccgccgaaauacgacugaugugcacggagaccuauuuagacacacccagaccugaugacggcuccaucacugggccaugugagagcaauggagauaaggguucgggcgggauuaaaggaggcuucgugcaucaaaggauggcaucuaagaucggucggugguacucccguaccaugucaaaaacaaagcgcauggggaugggccuguauguaaaguacgacggagaccccuggacugauagugacgcucucgcccuuagcggcguuaugguguccauggaggaaccggggugguacucuuuuggauucgaaauaaaagauaagaaaugcgacgucccuuguauugguaucgagauggugcacgauggcgggaaggaaaccuggcauagcgcugccacagcaaucuauugccugaugggaucaggccaguugcuaugggacaccgugacuggugucgauauggcccuguga

SEQ ID NO: 151982 - RNA, 1401 nt, Artificial Sequence; identical to SEQ ID NO: 151981
  derived and/or modified sequence opt3 from neuraminidase__InfluenzaB__AHL91611

SEQ ID NO: 151983 - RNA, 1401 nt, Artificial Sequence; identical to SEQ ID NO: 151973
  derived and/or modified sequence opt3 from neuraminidase__InfluenzaB__AHL91622

SEQ ID NO: 151984 - RNA, 1401 nt, Artificial Sequence; identical to SEQ ID NO: 151974
  derived and/or modified sequence opt3 from neuraminidase__InfluenzaB__AHL91633

SEQ ID NO: 151985 - RNA, 1401 nt, Artificial Sequence; identical to SEQ ID NO: 151974
  derived and/or modified sequence opt3 from neuraminidase__InfluenzaB__AHL91644

SEQ ID NO: 151986 - RNA, 1401 nt, Artificial Sequence
  derived and/or modified sequence opt3 from neuraminidase__InfluenzaB__AHL91655
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaagaaguaacacuccugcugcccgagccugaauggaccuauccaaggcucagcugucccggaaguacuuuccagaaggccuuacugaucuccccucaccgguuuggugagacaaaaggcaauucugcaccacuuauuauccgcgaacccuucauugccugcgggccuaaggaguguaaacauuuugcuuugacccacuacgcagcccagccaggaggcuauuacaacgguacgcgaggggaccguaauaagcugagacaucuaaucagcgugaagcucggaaaaauaccgacugucgagaacuccaucuuccacauggcugccuggucaggcagugcgugccaugauggcaaggaauggaccuauauugggguggacggacccgauagcaaugcacugcuuaaaaucaaguacggugaggccuacacagacacuuaucacucuuacgcuaacaauauucugaggacccaggaauccgccuguaacugcaucggcgggaauuguuauuugaugauaacagauggaucagcaagcggcauuagugagugccgguuucucaaaauccgcgaggguagaauuaucaaggaaaucuucccuaccgggaggguuaagcacacggaggaauguacuugcggauuugcuucuaacaaaacaauugagugugccugccgggacaauuccuacaccgcgaagcgcccauucgugaaacugaacgucgaaacugauacagccgagauacgauuaaugugcaccgagacguaucuggacacccccagaccugaugacggcagcaucacaggcccaugugaaucgaauggggauaagggaucugguggcauuaaagggggauuugugcaucaaaggauggcauccaagaucggccggugguacucacguacuaugaguaaaaccaagcgcauggguauggggcucuauguaaaguacgacggcgaccccuggacagauagcgacgcucuugcccuguccggaguuauggugucuauggaggaaccgggcugguacagcuucggguuugagauaaaagauaagaaaugcgacgucccuuguauuggaaucgaaauggugcacgaugguggcaaggagacuuggcauucagcugccaccgcaaucuauugcuugauggggaguggacagcuacugugggacacagugaccggcgucgauauggcccucuga

SEQ ID NO: 151987 - RNA, 1401 nt, Artificial Sequence; identical to SEQ ID NO: 151973
  derived and/or modified sequence opt3 from neuraminidase__InfluenzaB__AHL91666

SEQ ID NO: 151988 - RNA, 1401 nt, Artificial Sequence; identical to SEQ ID NO: 151974
  derived and/or modified sequence opt3 from neuraminidase__InfluenzaB__AHL91677

SEQ ID NO: 151989 - RNA, 1401 nt, Artificial Sequence; identical to SEQ ID NO: 151975
  derived and/or modified sequence opt3 from neuraminidase__InfluenzaB__AHL91688

SEQ ID NO: 151990 - RNA, 1401 nt, Artificial Sequence; identical to SEQ ID NO: 150703
  derived and/or modified sequence opt3 from neuraminidase__InfluenzaB__AHL91699

SEQ ID NO: 151991 - RNA, 1401 nt, Artificial Sequence
  derived and/or modified sequence opt3 from neuraminidase__InfluenzaB__AHL91710
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaaggaauguaaacacuuugcuuugacccauuacgcagcccagccaggcgguuauuacaacgggacgcgcggagaccgaaauaagcugcgucaccuaaucagcgugaagcucggcaaaauaccgacugucgagaacuccaucuuccauauggcugccuggucaggcagugcgugccacgaugggaaggaguggaccuauauuggaguggacggucccgauagcaaugcacugcuuaaaaucaaguacggcgaagccuacacagacacuuaucacucuuacgcuaacaauauucugagaacccaggaguccgccuguaacugcaucgggggaaauuguuauuugaugauaacagauggcucagcaagcgguauuagugaaugcagguuucucaaaauccgggaggggcgcauuaucaaggagaucuucccuaccggaagaguuaagcauacggaagaguguacuugcggcuuugcuucuaacaaaacaauugaaugugccugcagggacaauuccuacaccgcgaagcggccauucgugaaacugaacgucgagacugauacagccgaaauacgcuuaaugugcaccgagacguaucuggacacaccccgaccugaugacggcagcaucaccgggccaugugagucgaauggagauaaggguucuggcgggauuaaaggaggcuuugugcaccaaagaauggcauccaagaucgguaggugguacucacggacuaugaguaaaaccaagcguauggggaugggccucuauguaaaguacgacggagaccccuggacagauagcgacgcucuugcccuguccggcguuauggugucuauggaggaaccggggugguacagcuucggauuugaaauaaaagauaagaaaugcgacgucccuuguauugguaucgagauggugcaugauggcgggaaggaaacuuggcacucagcugccaccgcaaucuauugcuugaugggaaguggccagcuacugugggacacagugaccggugucgauauggcccucuga

SEQ ID NO: 151992 - RNA, 1401 nt, Artificial Sequence; identical to SEQ ID NO: 150630
  derived and/or modified sequence opt3 from neuraminidase__InfluenzaB__AHL91721

SEQ ID NO: 151993 - RNA, 1401 nt, Artificial Sequence; identical to SEQ ID NO: 150698
  derived and/or modified sequence opt3 from neuraminidase__InfluenzaB__AHL91732

SEQ ID NO: 151994 - RNA, 1401 nt, Artificial Sequence; identical to SEQ ID NO: 150630
  derived and/or modified sequence opt3 from neuraminidase__InfluenzaB__AHL91743

SEQ ID NO: 151995 - RNA, 1401 nt, Artificial Sequence
  derived and/or modified sequence opt3 from neuraminidase__InfluenzaB__AHL91754
augcugcccagcaccauccagacacucacucuucuguugacguccggcgggguguuacugucucuauacgucucagccagucucagcuaucugcuuuacuccgacauucuguugaaguucucuccuaccgagauaacagcuccaacuaugccgcucgauugcgcaaacgccucgaauguucaagcggugaacagaucagcuaccaaaggaguaacacugcugcuccccgaaccugaguggaccuauccaagguuaagcugucccgguaguacuuuucagaaggcccugcuuaucuccccucaccgguucggcgaaacaaaaggaaauucugcaccauugauuauccgcgagcccuuuauugccugcgggccuaaggaauguaaacauuucgcucugacccacuacgcagcccagccaggcgguuauuacaacgggacgcgaggagaccguaauaagcuaagacaucucaucagcgugaagcugggcaaaauaccgacugucgagaacuccaucuuucacauggcugccuggucaggcagugcgugccaugaugggaaggaguggaccuauauuggaguggacggucccgauagcaaugcacuucugaaaaucaaguacggcgaagccuacacagacacuuaucacucuuacgcuaacaauauuuugaggacccaggaguccgccuguaacugcaucgggggaaauuguuaucucaugauaacagauggcucagcaagcgguauuagugaaugccgguuccugaaaauccgcgaggggagaauuaucaaggagaucuuuccuaccggaaggguuaagcacacggaagaguguacuugcggcuucgcuucuaacaaaacaauugaaugugccugccgggacaauuccuacaccgcgaagcgcccauuugugaaauuaaacgucgagacugauacagccgaaauacgacugaugugcaccgagacguaucucgacacccccagaccugaugacggcagcaucacagggccaugugagucgaauggagauaaggguucuggcgggauuaaaggaggcuucgugcaucaaaggauggcauccaagaucggucggugguacucacguacuaugaguaaaaccaagcgcauggggaugggccuuuauguaaaguacgacggagaccccuggacagauagcgacgcucuggccuuguccggcguuauggugucuauggaggaaccggggugguacagcuuuggauucgaaauaaaagauaagaaaugcgacgucccuuguauugguaucgagauggugcacgauggcgggaaggaaacuuggcauucagcugccaccgcaaucuauugccuaaugggaaguggccagcugcucugggacacagugaccggugucgauauggcccuguga

SEQ ID NO: 151996 - RNA, 1401 nt, Artificial Sequence; identical to SEQ ID NO: 150630
  derived and/or modified sequence opt3 from neuraminidase__InfluenzaB__AHL91765

SEQ ID NO: 151997 - RNA, 1401 nt, Artificial Sequence
  derived and/or modified sequence opt3 from neuraminidase__InfluenzaB__AHL91776
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaccuccaucuuccacauggcugccuggucaggcagugcgugccaugaugggaaggaguggacauauauuggaguggacggucccgauaacaaugcacugcuuaaaaucaaguacggcgaagccuacacugacaccuaucacagcuacgcuaacaauauucugaggacacaggagucugccuguaacugcaucgggggaaauuguuauuugaugauaaccgauggcuccgcaucagguguuagcgaaugccgguuucucaaaauucgcgaggggagaaucauuaaggagaucuucccuacgggaagggugaagcacacugaagaguguacaugcggcuuugcuaguaacaaaaccaucgaaugugccugccgggacaauucuuacacugcgaagcgcccauucgucaaacugaacguggagacagauaccgccgaaauucgauuaaugugcacggagaccuaucuggacacacccagaccugaugacggcuccauaacugggccaugugagagcaauggagauaaggguucgggcgggaucaaaggaggcuuuguacaucaaaggauggcaucuaagauuggucggugguacucccguaccaugucaaaaacagaacgcauggggaugggccucuauguuaaguacgacggagaccccugggcugauagugacgcccuugcucugagcggcgugauggucuccauggaggaaccggggugguacucuuucggauuugagaucaaggauaaaaagugcgacgugccuuguauagguauugaaauggugcacgauggcgggaaagagacuuggcauagcgccgcaaccgccaucuauugcuugaugggaucaggccagcuacugugggacacagucaccgguguugauauggcucucuga

SEQ ID NO: 151998 - RNA, 1401 nt, Artificial Sequence; identical to SEQ ID NO: 151997
  derived and/or modified sequence opt3 from neuraminidase__InfluenzaB__AHL91787

SEQ ID NO: 151999 - RNA, 1401 nt, Artificial Sequence; identical to SEQ ID NO: 151997
  derived and/or modified sequence opt3 from neuraminidase__InfluenzaB__AHL91798

SEQ ID NO: 152000 - RNA, 1401 nt, Artificial Sequence; identical to SEQ ID NO: 150634
  derived and/or modified sequence opt3 from neuraminidase__InfluenzaB__AHL91809

SEQ ID NO: 152001 - RNA, 1401 nt, Artificial Sequence
  derived and/or modified sequence opt3 from neuraminidase__InfluenzaB__AHL91820
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugguuacagauggcuccgcaucaggugugagcgaaugccgguuucucaagauacgcgaggggagaauuaucaaagagauuuucccuaccggaagggucaagcacacggaagaguguacuugcggcuuugcuaguaacaagacaaucgaaugugccugccgggacaauucuuacaccgcgaaacgcccauucgugaagcugaacguagagacugauacagccgaaauccgauuaaugugcaccgagacguaucuggacacccccagaccugaugacggcuccauuacagggccaugugagagcaacggagauaaagguucgggcgggauaaagggaggcuuuguucaucaaaggauggcaucuaaaaucggucggugguacucccguacuaugucaaagaccgaacgcauggggaugggccucuaugugaaauacgacggagaccccugggcugauagugacgcccuugcucugagcggcgucaugguguccauggaggaaccggggugguacucuuucggauuugagauuaaggauaagaaaugcgacgugccuuguaucgguauagaaaugguccacgauggcgggaaggagacauggcauagcgccgcaacugccauuuauugcuugaugggaucaggccagcuacugugggacaccguuacagguguggauauggcucucuga

SEQ ID NO: 152002 - RNA, 1401 nt, Artificial Sequence
  derived and/or modified sequence opt3 from neuraminidase__InfluenzaB__AHL91831
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcacacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgagacguaucuggacacccccagaccugaugacggcuccauaacagggccaugugagagcaacggagauaaagguucgggcgggaucaagggaggcuuuguacaucaaaggaugacuucuaaaauuggucggugguacucccguaccaugucaaagacagaacgcauggggaugggccucuauguuaaauacgacggagaccccugggcagauagugacgcucuugcccugagcggcgugauggucuccauggaggaaccggggugguacucuuucggauuugagaucaaggauaagaaaugcgacgugccuuguauagguauugaaauggugcacgauggcgggaaggagacuuggcauagcgcugccaccgcaaucuauugcuugaugggaucaggccagcuacugugggacacagucaccgguguugauauggcccucuga

SEQ ID NO: 152003 - RNA, 1401 nt, Artificial Sequence; identical to SEQ ID NO: 151147
  derived and/or modified sequence opt3 from neuraminidase__InfluenzaB__AHL91842

SEQ ID NO: 152004 - RNA, 1401 nt, Artificial Sequence
  derived and/or modified sequence opt3 from neuraminidase__InfluenzaB__AHL91853
augcugcccagcaccauccagacacucacucuuuuccugacguccggcgggguguuguuaucucuguacgucucagccagucuaagcuaucuccuguacuccgacauucuucugaaguuuucuaccacagagauaacugcuccuaccaugccaucggauugcgcaaacgccucaaauguucaagcggugaacagaagcgcuacaaaaggaguaaccuugcuccugccggaacccgaguggacuuauccuaggcugaguuguccagguuccacauuccagaaggcccucuuaaucucuccccaccgguuuggcgaaaccaaagggaauagcgcaccucugauuauccgcgagccauucauugccugcggacccaaggaauguaaacauuuugcucuuacgcacuacgcagcccagccuggcgguuauuacaacgggacucgagaggaccguaauaaguugagacaucugaucuccgugaagcuaggaaaaauaccaaccgucgagaacucaaucuuccacauggcugccuggaguggcagcgcgugccaugauggcaaggaauggacauauauugggguggacggaccggauucuaaugcacuccugaaaaucaaguacggugaggccuacacugacaccuaucacuccuacgcuaacaauauucuuaggacacaggaaucagccuguaacugcaucggcgggaauuguuaucugaugauaaccgauggaagcgcaaguggcauuucugagugccgguuuuugaaaauccgcgaggguagaauuaucaaggaaaucuuccccacggggaggguuaagcacacugaggaauguacaugcggauuugcuuccaacaaaaccauugagugugccugccgggacaauagcuacacugcgaagcgcccuuucgugaaacucaacgucgaaacagauaccgccgagauacgacugaugugcacggagaccuauuuagacacaccaagacccgaugacggcucgaucacuggcccuugugaaucuaaugggaacaagggauccgguggcauuaaagggggauuugugcaucaaaggauggcaucaaagaucggccggugguacagucguaccaugagcaaaacaaagcgcauggguauggggcuguauguaaaguacgauggcgacccauggacugacuccgaugcucucgcccuuucuggaguuauggugagcauggaggaacccggcugguacucauucggguuugagauaaaagacaagaaaugcgaugucccguguauuggaaucgaaauggugcacgacgguggcaaggagaccuggcauagugcugccacagcaaucuauugccugaugggguccggacaguugcuaugggauaccgugacuggcgucgacauggcccuguga

SEQ ID NO: 152005 - RNA, 1401 nt, Artificial Sequence; identical to SEQ ID NO: 151145
  derived and/or modified sequence opt3 from neuraminidase__InfluenzaB__AHL91864

SEQ ID NO: 152006 - RNA, 1401 nt, Artificial Sequence; identical to SEQ ID NO: 151145
  derived and/or modified sequence opt3 from neuraminidase__InfluenzaB__AHL91875

SEQ ID NO: 152007 - RNA, 1401 nt, Artificial Sequence; identical to SEQ ID NO: 150902
  derived and/or modified sequence opt3 from neuraminidase__InfluenzaB__AHL91886

SEQ ID NO: 152008 - RNA, 1401 nt, Artificial Sequence; identical to SEQ ID NO: 150643
  derived and/or modified sequence opt3 from neuraminidase__InfluenzaB__AHL91897

SEQ ID NO: 152009 - RNA, 1401 nt, Artificial Sequence; identical to SEQ ID NO: 150643
  derived and/or modified sequence opt3 from neuraminidase__InfluenzaB__AHL91908

SEQ ID NO: 152010 - RNA, 1401 nt, Artificial Sequence
  derived and/or modified sequence opt3 from neuraminidase__InfluenzaB__AHL91919
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcuacuaaaggaguaaccccgcuccugcccgaaccugaguggacauauccaaggcugagcugucccgguaguaccuuccagaaggcccucuuaauuuccccucaccgguuuggcgaaacuaaaggaaauucugcaccacugaucauucgcgagcccuucaucgccugcgggccuaaggaauguaaacauuuugcucuuacacacuacgcagcccagccaggcgguuauuacaacgggacccgagaggaccguaauaaguugagacaucugauaagcgugaagcuaggaaaaaucccgacggucgagaacuccauuuuccacauggcugccuggucaggcagugcgugccaugauggcagggaauggacuuauaucgggguggacggacccgauagcaaugcacuccugaagauuaaauacggugaggccuacaccgacacauaucacucuuacgcuaagaacauccuucggacucaagaauccgccuguaauugcauaggcggggauuguuaucugaugauuaccgacggaccugcaucaggcaucagcgagugccgcuuuuugaaaauuagagaggguaggaucaucaaggaaauuuucccaacagggcggguuaagcacaccgaggaauguacgugcggauuugcuaguaacaaaacuauagagugugccugccgcgauaauucuuacacagcgaagcgacccuucgugaaacucaacgucgaaaccgacacugccgagaucagacugaugugcacagagaccuauuuagauacgccuaggccaaaugacggcuccauuaccggccccugugaaagcaacggggauaagggaucggguggcaucaaagggggauuugugcaucagcggauggcaucuaagauaggccguugguacucccgcacaaugucaaaaacuaagagaauggguauggggcuguauguaaaguacgacggcgacccguggaccgauagugaggcucucgcccuuagcggaguuaugguguccauggaggaaccuggcugguacucuuucggguuugaaauuaaagacaagaaaugcgauguccccuguaucggaaucgagauggugcacgacgguggcaagacaacuuggcauagcgcugccaccgcaauuuauugccugauggggucaggacaguugcuaugggauacagugaccggcgucgacauggcccuguga

SEQ ID NO: 152011 - RNA, 1401 nt, Artificial Sequence; identical to SEQ ID NO: 151705
  derived and/or modified sequence opt3 from neuraminidase__InfluenzaB__AHL91930

SEQ ID NO: 152012 - RNA, 1401 nt, Artificial Sequence; identical to SEQ ID NO: 150643
  derived and/or modified sequence opt3 from neuraminidase__InfluenzaB__AHL91941

SEQ ID NO: 152013 - RNA, 1401 nt, Artificial Sequence; identical to SEQ ID NO: 150643
  derived and/or modified sequence opt3 from neuraminidase__InfluenzaB__AHL91952

SEQ ID NO: 152014 - RNA, 1401 nt, Artificial Sequence; identical to SEQ ID NO: 150686
  derived and/or modified sequence opt3 from neuraminidase__InfluenzaB__AHL91963

SEQ ID NO: 152015 - RNA, 1401 nt, Artificial Sequence
  derived and/or modified sequence opt3 from neuraminidase__InfluenzaB__AHL91974
augcugcccagcaccauccagacacucacucuuuuccugacguccggcgggguguuguuaucucuguacgucucagccagucuaagcuaucuccuguacuccgacauucuucugaaguuuucuccuaccgagauaacaacuccaaccaugccguuggauugcgcuaacgcaucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaacgaauguaagcauuuugccuugacgcacuacgcugcacagccaggcgguuauuacaaugggacucgaggagaccguaacaaacugagacaucuaaucagcgugaagcucggcaagauaccgaccgucgaaaauuccaucuuccacauggccgcuuggucaggcagugccugccaugaugggaaagaguggacauauauuggaguggacggucccgauaacaaugcgcugcuuaagaucaaauacggcgaggcauacacugacaccuaucacagcuacgccaacaauauucugaggacacaggagucugcuuguaacugcaucgggggaaauuguuauuugaugauaaccgauggcuccgccucagguguuagcgaaugccgguuucucaagauucgcgaggggagaaucauuaaagagaucuucccuacgggaagggugaagcacacugaagaguguacaugcggcuuugcaaguaacaagaccaucgaaugugcuugccgggacaauucuuacacugccaaacgcccauucgucaagcugaacguggagacagauaccgcggaaauucgauuaaugugcacggacaccuaucuggauacacccagaccugacgauggcuccauaacugggccaugugagagcaacggagacaaagguucgggcgggaucaagggaggcuuuguacaucaaaggauggccucuaaaauuggucggugguacucccguaccaugucaaagacagagcgcauggggaugggccucuauguuaaauacgacggagaucccugggcagacagugaugcucuugccuucagcggcgugauggucuccaugaaggaaccggggugguacucuuuuggauucgagaucaaggacaaaaagugcgaugugccuuguauagguauugaaauggugcacgacggcgggaaagagacuuggcauagcgcugccaccgcaaucuauugccugaugggaucaggccaguugcuaugggauacagucaccgguguugacauggcccuguga

SEQ ID NO: 152016 - RNA, 1401 nt, Artificial Sequence; identical to SEQ ID NO: 150686
  derived and/or modified sequence opt3 from neuraminidase__InfluenzaB__AHL91985

SEQ ID NO: 152017 - RNA, 1401 nt, Artificial Sequence; identical to SEQ ID NO: 150643
  derived and/or modified sequence opt3 from neuraminidase__InfluenzaB__AHL91995

SEQ ID NO: 152018 - RNA, 1401 nt, Artificial Sequence
  derived and/or modified sequence opt3 from neuraminidase__InfluenzaB__AHL92006
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagaucaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggccaugugagagcaacggagacaaggguucgggcgggaucaaaggaggcuuuguacaucaaaggauggcaucuaagauuggucggugguacucccguacuaugucaaaaaccgagcgcauggggaugggccucuauguuaaguacgacggagaucccugggcugacagugaugcccuugcuuucagcggcgugauggucuccaugaaggaaccggggugguacucuuuuggauucgagaucaaagacaagaaaugcgaugugccuuguauagguguggaaaugguccacgacggcgggaaggagacauggcauagcgccgcaacugccauuuauugccugaugggaucaggccaguugcuaugggauaccguuacagguguggacauggcucuguga

SEQ ID NO: 152019 - RNA, 1401 nt, Artificial Sequence; identical to SEQ ID NO: 150651
  derived and/or modified sequence opt3 from neuraminidase__InfluenzaB__AHL92017

SEQ ID NO: 152020 - RNA, 1401 nt, Artificial Sequence; identical to SEQ ID NO: 150651
  derived and/or modified sequence opt3 from neuraminidase__InfluenzaB__AHL92028

SEQ ID NO: 152021 - RNA, 1401 nt, Artificial Sequence
  derived and/or modified sequence opt3 from neuraminidase__InfluenzaB__AHL92039
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaucuauccaaggcucagcugucccgguaguaccuuccaaaaggccuuacugauuuccccucaucgguuuggcgaaacuaaaggaaauucugcaccacuuaucauucgcgagcccuucaucgccugcgggccuaacgaauguaagcacuuugcuuugacacauuacgcagcccagccaggcgguuauuacaaugggacccgaggagaccguaacaaacugagacaccuaauaagcgugaagcucggcaagaucccgacggucgaaaauuccauuuuccauauggcugccuggucaggcagugcgugccacgaugggaaagaguggacuuauaucggaguggacggucccgauaacaaugcacugcuuaagauuaaauacggcgaggccuacaccgacacauaucacagcuacgcuaacaauauccugaggacucaggagucugccuguaacugcauagggggaaauuguuauuugaugauuaccgauggcuccgcaucagguguuagcgaaugccgguuucucaagauccgcgaggggagaauuaucaaagagaucuucccuacaggaagggugaagcauaccgaagaguguacgugcggcuuugcuaguaacaagacuauugaaugugccugccgggacaauucuuacacagcgaaacgcccauucgucaagcugaacguggagaccgauacugccgaaauacgauuaaugugcacagacaccuaucuggauacgcccagaccugacgauggcuccaucaccgggccaugugagagcaacggagacaaagguucgggcgggauuaagggaggcuuuguacaccagaggauggcaucuaaaaucggucggugguacucccguacaaugucaaagacugagcgcauggggaugggccucuauguuaaauacaauggagaccccugggcugauagugacgcccuugcuuucagcggcgugauggucuccaugaaggaaccggggugguacucuuuuggauucgagauaaaggauaaaaagugcgacgugccuuguauugguaucgaaauggugcaugauggcgggaaagagaccuggcacagcgccgcaacagccaucuauugccugaugggaucaggccaauugcuaugggacacugucaccgguguugauauggcucuguga

SEQ ID NO: 152022 - RNA, 1401 nt, Artificial Sequence; identical to SEQ ID NO: 150651
  derived and/or modified sequence opt3 from neuraminidase__InfluenzaB__AHL92050

SEQ ID NO: 152023 - RNA, 1401 nt, Artificial Sequence
  derived and/or modified sequence opt3 from neuraminidase__InfluenzaB__AHL92061
augcugcccagcaccacacagacucucacgcuuuuccugaccuccggcgggguguuguuaucucuguacgucucagccagucuaagcuaucuccuguacuccgacauccuucugaaguuuucuccuacagagauuacugcuccaaccaugccguuggauugcgcaaacgccucgaauguucaagcggugaacagaucagcuacaaaaggaguaacccuccugcugcccgaaccugaguggacuuauccaaggcucagcugucccgguaguacauuccagaaggccuuacugauauccccucaccgguuuggcgaaaccaaaggaaauucugcaccacuuaucauucgcgagcccuucaucgccugcgggccuaacgaauguaagcauuuugcuuugacgcacuacgcagcccagccaggcgguuauuacaaugggacucgaggagaccguaacaaacugagacaucuaauuagcgugaagcucggcaagaucccgaccgucgaaaauuccauauuccacauggcugccuggucaggcagugcgugccaugaugggaaagaguggacauauaucggaguggacggucccgauaacaaugcacugcuuaagauuaaauacggcgaggccuacacugacaccuaucacagcuacgcuaacaagauccugaggacacaggagucugccuguaauugcauugggggaaacuguuauuugaugaucaccgauggcuccgcaucagguguuagcgaaugccgguuucucaaaauacgcgaggggagaauuaucaaggagauuuucccuacgggaagggugaagcacacugaagaguguacaugcggcuuugcuaguaauaaaaccaucgaaugugccugccgggacaacucuuacacugcgaagcgcccauucgucaaacugaauguggagacagauaccgccgaaauccgauuaaugugcacggacaccuaucuggauacacccagaccugacgauggcuccauuacugggccaugugagagcaacggagacaaggguucgggcgggauaaaaggaggcuuuguacaucaaaggauggcaucuaagaucggucggugguacucccguaccaugucaaaaacagagcgcauggggaugggccucuauguuaaguacgacggagaucccugggcugacagugaugcccuugcuuucagcggcgugauggucuccaugaaggaaccggggugguacucuuuuggauucgagauuaaagacaagaaaugcgaugugccuuguaucgguauagaaauggugcacgacggcgggaaggagacuuggcauagcgccgcaaccgccauuuauugccugaugggaucaggccaguugcuaugggauacagucaccgguguugacauggcucuguga

SEQ ID NO: 152024 - RNA, 1401 nt, Artificial Sequence
  derived and/or modified sequence opt3 from neuraminidase__InfluenzaB__AHL92072
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaacgaauguaagcacuuugcuuugacccauuacgcagcccagccaggcgguuauuacaaugggacgcgcggagaccgaaacaaacugcgucaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaagauucugagaacccaggagucugccuguaauugcaucgggggaaacuguuauuugaugauaacagauggcuccgcaucagguguuagcgaaugcagguuucucaaaauucgggaggggcgcaucauuaaggagaucuucccuaccggaagagugaagcauacggaagaguguacuugcggcuuugcuaguaauaaaacaaucgaaugugccugcagggacaacucuuacaccgcgaagcggccauucgucaaacugaauguggagacugauacagccgaaauucgcuuaaugugcaccgacacguaucuggauacaccccgaccugacgauggcuccauaaccgggccaugugagagcaacggagacaaggguucgggcgggaucaaaggaggcuuuguacaccaaagaauggcaucuaagauugguaggugguacucccggacuaugucaaaaaccgagcguauggggaugggccucuauguuaaguacgacggagaucccugggcugacagugaugcccuugcuuucagcggcgugauggucuccaugaaggaaccggggugguacucuuuuggauucgagaucaaagacaagaaaugcgaugugccuuguauagguauugaaauggugcaugacggcgggaaggagacauggcacagcgccgcaacugccaucuauugccugaugggaucaggccaguugcuaugggauaccgucacagguguugacauggcucuguga

SEQ ID NO: 152025 - RNA, 1401 nt, Artificial Sequence; identical to SEQ ID NO: 152024
  derived and/or modified sequence opt3 from neuraminidase__InfluenzaB__AHL92083

SEQ ID NO: 152026 - RNA, 1401 nt, Artificial Sequence; identical to SEQ ID NO: 152024
  derived and/or modified sequence opt3 from neuraminidase__InfluenzaB__AHL92094

SEQ ID NO: 152027 - RNA, 1401 nt, Artificial Sequence
  derived and/or modified sequence opt3 from neuraminidase__InfluenzaB__AHL92105
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguggcgggggaaucaagggcgguuuuguacaccagaggauggcaucgaaaauugggcggugguacucucguacuauguccaagaccgagcgcaugggcaugggacucuauguuaaauacgacggcgaucccugggcugacucagaugcccuugcuuucaguggggugauggucagccugaaggaaccgggaugguacuccuuugguuucgagaucaaggacaaaaagugcgaugugccuuguauaggcauugaaauggugcaugacgggggaaaagagacauggcacucugccgcaacugccaucuauugcuugaugggcagcggucaacuacugugggauaccgucacagggguugacauggcucucuga

SEQ ID NO: 152028 - RNA, 1401 nt, Artificial Sequence; identical to SEQ ID NO: 150804
  derived and/or modified sequence opt3 from neuraminidase__InfluenzaB__AHL92116

SEQ ID NO: 152029 - RNA, 1401 nt, Artificial Sequence; identical to SEQ ID NO: 152024
  derived and/or modified sequence opt3 from neuraminidase__InfluenzaB__AHL92127

SEQ ID NO: 152030 - RNA, 1401 nt, Artificial Sequence; identical to SEQ ID NO: 152024
  derived and/or modified sequence opt3 from neuraminidase__InfluenzaB__AHL92138

SEQ ID NO: 152031 - RNA, 1401 nt, Artificial Sequence; identical to SEQ ID NO: 152024
  derived and/or modified sequence opt3 from neuraminidase__InfluenzaB__AHL92149

SEQ ID NO: 152032 - RNA, 1401 nt, Artificial Sequence
  derived and/or modified sequence opt3 from neuraminidase__InfluenzaB__AHL92171
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugguguccccucauagguuuggcgaaacaaaaggaaauucugcaccacuuaucauucgggagcccuucaucgccugcgggccuaacgaauguaagcacuuugcuuugacccauuacgcagcccagccaggcgguuauuacaaugggacgcgcggagaccgaaacaaacugcgucaccuaauuagcgucaagcucggcaagaucccgacuguggaaaauuccauauuccauauggcugccuggucaggcagugcgugccacgaugggaaagaguggaccuauaucggaguugacggucccgauaacaaugcacugcuuaagauuaaauacggcgaggccuacacagacacuuaucacagcuacgcuaacaagauccugagaacccaggagucugccuguaauugcauugggggaaacuguuauuugaugaucacagauggcuccgcaucaggugugagcgaaugcagguuucucaaaauacgggaggggcgcauuaucaaggagauuuucccuaccggaagagucaagcauacggaagaguguacuugcggcuuugcuaguaauaaaacaaucgaaugugccugcagggacaacucuuacaccgcgaagcggccauucgugaaacugaauguagagacugauacagccgaaauccgcuuaaugugcaccgacacguaucuggauacaccccgaccugacgauggcuccauuaccgggccaugugagagcaacggagacaaggguucgggcgggauaaaaggaggcuuuguucaccaaagaauggcaucuaagaucgguaggugguacucccggacuaugucaaaaaccgagcguauggggaugggccucuaugugaaguacgacggagaucccugggcugacagugaugcccuugcuuucagcggcgucaugguguccaugaaggaaccggggugguacucuuuuggauucgagauuaaagacaagaaaugcgaugugccuuguaucgguauagaaaugguccaugacggcgggaaggagacauggcacagcgccgcaacugccauuuauugccugaugggaucaggccaguugcuaugggauaccguuacagguguggacauggcucuguga

SEQ ID NO: 152033 - RNA, 1401 nt, Artificial Sequence
  derived and/or modified sequence opt3 from neuraminidase__InfluenzaB__AHL92182
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugagugggccuauccaaggcucagcugucccgguaguaccuuccaaaaggcauuacugaucuccccucaucgguuuggcgaaacuaaaggaaauucugccccacuuauuauccgcgagcccuucauugcuugcgggccuaacgaauguaagcacuuugcauugacacauuacgccgcucagccaggcgguuauuacagcgggacccgaggagaccguaauaaacugagacaccuaaucuccgugaagcucggcaagauaccgacggucgagaacucaaucuuccauauggccgcguggaguggcagcgcaugccacgaugggaaagaguggacuuauauuggaguggacggucccgauaauaacgcccugcuuaagaucaaauacggcgaggcuuacaccgacacauaucacucuuacgccaauaacauucugaggacucaggaauccgcauguaauugcaucgggggaaacuguuauuugaugauaaccgauggcucagcuagcgguguuagugaaugccgguuucucaagauucgcgaggggagaaucauuaaagagaucuucccuacaggaagggugaagcauaccgaagaguguacgugcggcuuugccucuaauaagacuaucgaaugugcgugccgggacaacuccuacacagccaaacgcccauucgucaagcugaauguggagaccgauacugcagaaauucgauuaaugugcacagacaccuaucuggauacgcccagaccugacgauggcagcauaaccgggccaugugagucgaacggagacaaagguucuggcgggaucaagggaggcuuuguacaccagaggauggcuuccaaaauuggucggugguacucacguacaaugaguaagacugagcgcauggggaugggccucuauguuaaauacgacggagaucccugggccgacagcgaugcucuugccuucuccggcgugauggucucuaugaaggaaccggggugguacagcuuuggauucgagaucaaggacaaaaagugcgaugugccuuguauagguauugaaauggugcaugacggcgggaaagagaccuggcacucagcagccacagcuaucuauugccugaugggaaguggccaauugcuaugggauacugucaccgguguugacauggcgcuguga

SEQ ID NO: 152034 - RNA, 1401 nt, Artificial Sequence; identical to SEQ ID NO: 152033
  derived and/or modified sequence opt3 from neuraminidase__InfluenzaB__AHL92193

SEQ ID NO: 152035 - RNA, 1401 nt, Artificial Sequence; identical to SEQ ID NO: 150804
  derived and/or modified sequence opt3 from neuraminidase__InfluenzaB__AHL92204

SEQ ID NO: 152036 - RNA, 1401 nt, Artificial Sequence
  derived and/or modified sequence opt3 from neuraminidase__InfluenzaB__AHL92215
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaacgaauguaagcacuuugcuuugacccauuacgcagcccagccaggcgguuauuacaaugggacgcgcggagaccgaaacaaacugcgucaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaagauucugagaacccaggagucugccuguaauugcaucgggggaaacuguuauuugaugauaacagauggcuccgcaucagguguuagcgaaugcagguuucucaaaauucgggaggggcgcaucauuaaggagaucuucccuaagggaagagugaaacauaccgaagaguguacgugcggcuuugcuaguaauaagacuaucgaaugugccugcagggacaacucuuacacagcgaaacggccauucgucaagcugaauguggagaccgauacugccgaaauucgcuuaaugugcacagacaccuaucuggauacgccccgaccugacgauggcuccauaaccgggccaugugagagcaacggagacaaagguucgggcgggaucaagggaggcuuuguacaccaaagaauggcaucuaaaauugguaggugguacucccggacaaugucaaagacugagcguauggggaugggccucuauguuaaguacgacggagaucccugggcugacagugaugcccuugcuuucagcggcgugauggucuccaugaaagaaccggggugguacucuuuuggauucgagaucaaggacaaaaagugcgaugugccuuguauagguauugaaauggugcaugacggcgggaaagagaccuggcacagcgccgcaacagccaucuauugccugaugggaucaggccaguugcuaugggauacugucaccgguguugacauggcucuguga

SEQ ID NO: 152037 - RNA, 1401 nt, Artificial Sequence; identical to SEQ ID NO: 152024
  derived and/or modified sequence opt3 from neuraminidase__InfluenzaB__AHL92226

SEQ ID NO: 152038 - RNA, 1401 nt, Artificial Sequence; identical to SEQ ID NO: 150804
  derived and/or modified sequence opt3 from neuraminidase__InfluenzaB__AHL92237

SEQ ID NO: 152039 - RNA, 1401 nt, Artificial Sequence; identical to SEQ ID NO: 152024
  derived and/or modified sequence opt3 from neuraminidase__InfluenzaB__AHL92248

SEQ ID NO: 152040 - RNA, 1401 nt, Artificial Sequence
  derived and/or modified sequence opt3 from neuraminidase__InfluenzaB__AHL92259
augcugcccagcaccauccagacacucacucuuuuccugacguccggcgggguguuguuaucucuguacgucucagccagucuaagcuaucuccuguacuccgacauucuucugaaguuuucuccuaccgagauaacagcuucgacuaugccauuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaagggaauagcgcaccucuuauuauccgcgagccauucauugccugcggacccaacgaauguaagcauuuugcuuugacccacuacgcagcccagccuggcgguuauuacaaugggacgcgaggagaccguaacaaacugagacaucuaaucuccgugaagcucggcaagauaccaacugucgaaaauucaaucuuccacauggcugccuggaguggcagcgcgugccaugaugggaaagaguggaccuauauuggaguggacgguccggauaacgacgcacugcuuaagaucaaauacggcgaggccuacacagauacuuaucacucuuacgcuaauaagauucugaggacccaggaguccgccuguaacugcaucgggggaaauuguuauuugaugauaacagacggcucagcaagcgguguuagugaaugccgguuucucaaaauucgcgaggggagaaucauuaaggagaucuuccccaccggaagggugaagcacacggaagaguguacuugcggcuuugcuucuaacaaaacaaucgaaugugccugccgggauaauuccuacaccgcgaagcgcccuuucgucaaacugaacguggagacugacacagccgaaauucgauuaaugugcaccgauacguaucuggacaccccaagacccgaugacggcagcauaacagggccuugugagucgaauggagacaaggguucuggcgggaucaaaggaggcuuuguacaucaaaggaugacuuccaagauuggucggugguacucacguaccaugaguaaaacagagcgcauggggaugggccucuauguuaaguacgauggagacccaugggcagauagcgacgcucuugccuucuccggcgugauggucucuaugaaggaacccgggugguacagcuuuggauucgagaucaaagauaagaaaugcgacgugccguguauagguauugaaauggugcacgauggcgggaaggagacuuggcauucagcugccaccgcaaucuauugccugaugggaaguggccaguugcuaugggacacagucaccgguguugauauggcccuguga

SEQ ID NO: 152041 - RNA, 1401 nt, Artificial Sequence; identical to SEQ ID NO: 152024
  derived and/or modified sequence opt3 from neuraminidase__InfluenzaB__AHL92270

SEQ ID NO: 152042 - RNA, 1401 nt, Artificial Sequence
  derived and/or modified sequence opt3 from neuraminidase__InfluenzaB__AHL92281
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggcuaaccacucagccaccaaaggagugacacuccugcugcccgaaccugaguggaccuauccaagacucagcugucccgguaguacuuuccagaaggcauuacugaucuccccucauagguuuggcgaaacaaaaggaaauucugccccacuuauuauccgggagcccuucauugcuugcgggccuaacgaauguaagcacuuugcauugacccauuacgccgcucagccaggcgguuauuacaaugggacgcgcggagaccgaaacaaacugcgucaccuaaucagcguaaagcucggcaagauaccgacuguggaaaauuccaucuuccauauggccgcguggucaggcagugcaugccacgaugggaaagaguggaccuauauuggagucgacggucccgauaacaaugcccugcuuaagaucaaauacggcgaggcuuacacagacacuuaucacagcuacgccaacaagauucugagaacccaggagucugcauguaauugcaucgggggaaacuguuauuugaugauaacagauggcuccgcuucaggugugagcgaaugcagguuucucaaaauucgggaggggcgcaucauuaaggagaucuucccuaccggaagaguuaagcauacggaagaguguacuugcggcuuugccaguaauaaaacaaucgaaugugcgugcagggacaacucuuacaccgccaagcggccauucgugaaacugaaugucgagacugauacagcagaaauucgcuuaaugugcaccgacacguaucuggauacaccccgaccugacgauggcuccauaaccgggccaugugagagcaacggagacaaggguucgggcgggaucaaaggaggcuuugugcaccaaagaauggcuucuaagauugguaggugguacucccggacuaugucaaaaaccgagcguauggggaugggccucuauguaaaguacgacggagaucccugggccgacagugaugcucuugccuucagcggcguuaugguguccaugaaggaaccggggugguacucuuuuggauucgagaucaaagacaagaaaugcgaugucccuuguauagguauugaaauggugcaugacggcgggaaggagacauggcacagcgcagccacugcuaucuauugccugaugggaucaggccaguugcuaugggauaccgugacaggugucgacauggcgcuguga

SEQ ID NO: 152043 - RNA, 1401 nt, Artificial Sequence
  derived and/or modified sequence opt3 from neuraminidase__InfluenzaB__AHL92303
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacauuccuccugcccgaaccugaguggaccuauccaaggcugagcugucccgguaguacuuuucaaaaggcccucuuaaucuccccucaucgguucggcgaaacaaaaggaaauucugcaccacugauuauccgcgagcccuuuauugccugcgggccuaacgaauguaagcacuucgcucuuacccauuacgcagcccagccaggcgguuauuacaaugggacgcgaggagaccguaacaaauugagacaccugaucagcgugaagcuaggcaagauaccgacugucgaaaauuccaucuuucauauggcugccuggucaggcagugcgugccacgaugggaaagaguggaccuauauuggaguggacggucccgauaacaaugcacuccugaagaucaaauacggcgaggccuacacagacacuuaucacagcuacgcuaacaauauucuuaggacccaggagucugccuguaacugcaucgggggaaauuguuaucugaugauaacagauggcuccgcaucagguguuagcgaaugccgguucuugaagauucgcgaggggagaaucauuaaagagaucuuuccuaccggaagggugaagcauacggaagaguguacuugcggcuucgcuaguaacaagacaaucgaaugugccugccgggacaauucuuacaccgcgaaacgcccauuugucaagcucaacguggagacugauacagccgaaauucgacugaugugcaccgacacguauuuagauacccccagaccugacgauggcuccauaacagggccaugugagagcaacggaaauaaagguucgggcgggaucaagggaggcuucguacaccagaggauggcaucuaaaauuggucggugguacucccguacuaugucaaagaccgagcgcauggggaugggccuguauguuaaauacgacggagaccccugggcugauagugacgcccucgcuuuuagcggcgugauggucuccaugaaggaaccggggugguacucuuucggauucgagaucaaggauaaaaagugcgacgugccuuguauagguauugaaauggugcaugauggcgggaaagagacauggcacagcgccgcaacugccaucuauugccuuaugggaucaggccaacuguugugggacaccgucacagguguugauauggcucuauga

SEQ ID NO: 152044 - RNA, 1401 nt, Artificial Sequence
  derived and/or modified sequence opt3 from neuraminidase__InfluenzaB__AHL92314
augcugcccagcaccauccagacacucacucuuuuccugacguccggcgggguguuguuaucucuguacgucucagccagucuaagcuaucuccuguacuccgacauucuucugaaguuuucucaaaccaaaauaacagcuccuaucaugccauuggauugcgcaaacgccucgaauguucaggcggugaacagaucagcugccaagggaguaacucuccugcugccggagcccgaauggaccuauccuaggcucagcuguccagguaguacauuccagaaagcauuacugauuucuccccaccgguuuggcgagaccaagggaaauuccgccccucuuaucauucgcgaaccauucaucgcuugcgggcccacugaguguaaacauuuugcauugacacacuacgccgcucagccuggcgguuauuacaacgggacccgagaagaccguaauaagcugagacaucuaauaagcgugaagcucggaaaaaucccaacggucgagaacuccauuuuccacauggccgcguggucaggcagugcaugccaugauggcaaggaguggacuuauguggggguugacggaccggauagcaaugcccugcuuaaaaucaaguacggugaggcuuacaccgacacauaucacucuuacgccaaaaacauucugaggacucaagaauccgcauguaauugcaucggcggggauuguuauuugaugauaaccgacggacccgcuucaggcauuagcgaaugccgguuucucaagauccgcgaggguagaauuaucaaggagaucuucccuacagggagggugaaacacaccgaagaguguacgugcggauuugccaguaacaagacuauugaaugugcgugccgggauaauucuuacacagccaaacgcccauucgucaagcugaacguggagaccgacacugcagaaauacgauuaaugugcacagagaccuaucuggauacgcccagaccuaaugacggcuccaucaccggcccaugugagagcgauggggacaaaggaucggguggcauuaaagggggauuuguacaucagaggauggcuucuaagaucggccggugguacucccguacaaugucaaagacuaagcgcauggguauggggcucuauguuaaauacgacggcgaucccuggaccgacagugaagcccuugcucugagcggagugauggucuccauggaugagccgggcugguacucuuucggguuugaaauaaaggacaaaaagugcgaugugccuuguauuggaaucgagauggugcacgacgguggcaaaacaacuuggcauagcgccgcaaccgccaucuauugcuugauggggucaggacagcuacugugggauacagucaccggcguugacauggcucucuga

SEQ ID NO: 152045 - RNA, 1401 nt, Artificial Sequence
  derived and/or modified sequence opt3 from neuraminidase__InfluenzaB__AHL92325
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugguguccaugggcgaaccggggugguacucuuucggauuugagauuaaagauaagaaaugcgacgucccuuguaucgguaucgaaauggugcacgauggcgggaagacaacuuggcauagcgccgcaaccgccauuuauugcuugaugggaucaggccagcuacugugggacacagugaccggugucgauauggcucucuga

SEQ ID NO: 152046 - RNA, 1401 nt, Artificial Sequence; identical to SEQ ID NO: 150804
  derived and/or modified sequence opt3 from neuraminidase__InfluenzaB__AHL92336

SEQ ID NO: 152047 - RNA, 1401 nt, Artificial Sequence
  derived and/or modified sequence opt3 from neuraminidase__InfluenzaB__AHL92358
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccaaggaauguaaacauuuugcauugacucacuacgccgcucagccuggcgguuauuacaacgggacacgagaggaccguaauaagcugagacaucuaauaagcgugaagcucggaaaaaucccaaccgucgagaacuccauuuuccacauggccgcguggucaggcagugcaugccaugauggcaaggaauggacguauguggggguugacggaccggauagcaaugcccugcuuaaaaucaaguacggugaggcuuacacugacaccuaucacucuuacgccaaaaacauucugaggacacaagaauccgcauguaauugcaucggcggggauuguuauuugaugauaacugacggacccgcuucaggcauuagcgagugccgguuucucaagauccgcgaggguagaauuaucaaggaaaucuucccuaccgggagggugaaacacacagaggaauguaccugcggauuugccaguaacaagacgauugagugugcgugccgggauaauucuuacacugccaaacgcccauucgucaagcugaacguggaaacagacaccgcagagauacgauuaaugugcacugagacauaucuggauacccccagaccuaaugacggcuccaucacgggcccaugugaaagcgauggggacaaaggaucggguggcauuaaagggggauuuguacaucagaggauggcuucuaagaucggccggugguacucccguaccaugucaaagacaaagcgcauggguauggggcucuauguuaaauacgacggcgaucccuggacugacagugaggcccuugcucugagcggagugauggucuccauggaggaaccgggcugguacucuuucggguuugaaauaaaggauaaaaagugcgacgugccuuguauuggaaucgagauggugcacgaugguggcaaaaccacauggcauagcgccgcaacugccaucuauugcuugauggggucaggacagcuacugugggacaccgucacaggcguugauauggcucucuga

SEQ ID NO: 152048 - RNA, 1401 nt, Artificial Sequence; identical to SEQ ID NO: 152047
  derived and/or modified sequence opt3 from neuraminidase__InfluenzaB__AHL92369

SEQ ID NO: 152049 - RNA, 1401 nt, Artificial Sequence
  derived and/or modified sequence opt3 from neuraminidase__InfluenzaB__AHL92380
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaagcuccugcugccggaacccgaguggaccuauccucggcucagcuguccagguaguacauuccagaaagccuuacugauuucuccccaccgcuuuggcgaaaccaagggaaauuccgcaccucuuaucauucgagagccauucaucgccugcgggcccaaagaauguaagcauuuugcuuugacucacuacgcagcccagccuggcgguuauuacaacgggacacgugaggacagaaauaagcugaggcaucuaauaagcgugaaacucggaaagaucccaaccgucgagaacuccauuuuccacauggcugccuggucaggcagugcgugccaugauggccgggaauggacguauaucgggguggacggaccggauagcaaugcacugcuuaaaauuaaguacggugaggccuacacugacaccuaucacucuuacgcuaaaaacauccugcgcacacaggaauccgccuguaauugcauaggcggggauuguuauuugaugauuacugacggacccgcaucaggcaucagcgagugcagauuucucaagauuagggagggucggaucaucaaggaaauuuucccuaccgggcgcguuaaacacacagaggaauguaccugcggauuugcuaguaacaagacgauagagugugccugccgagauaauucuuacacugcgaaaagaccauucgugaagcugaacgucgaaacagacaccgccgagaucagguuaaugugcacugagacauaucuggauacgccccggccuaaugacggcuccauuaccggcccaugugaaagcaacggggauaaaggaucggguggcaucaaagggggauuugugcaucaacguauggcaucuaagauaggccgcugguacuccagaaccaugucaaagacaaagaggauggguauggggcucuauguaaaauacgacggcgaccccuggacugauagugaggcucuugcccugagcggaguuaugguguccauggaggaaccgggcugguacucuuucggguuugaaauuaaggacaaaaagugcgaugucccuuguaucggaaucgagauggugcacgacgguggcaaaaccacauggcauagcgcugccacugcaauuuauugcuugauggggucaggacagcuacugugggauaccgugacaggcgucaauaugacccucuga

SEQ ID NO: 152050 - RNA, 1401 nt, Artificial Sequence
  derived and/or modified sequence opt3 from neuraminidase__InfluenzaB__AHL92391
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaagcaagcugaggcaucuaauauccgugaagcucggaaaaaucccaacggucgaaaauucaauuuuccacauggcugccuggaguggcagcgcgugccaugauggccgggaauggacuuauaucgggguggacggaccggauucuaacgcacugcuuaagauuaaauacggugaggccuacaccgacacauaucacuccuacgcuaagaauauccugcgcacucaggaaucagccuguaacugcauaggcggggauuguuauuugaugauuaccgacggacccgcaagcggcaucagugagugcagauuucucaaaauuagggagggucggaucaucaaggaaauuuucccuacagggcgcguuaagcacaccgaggaauguacgugcggauuugcuucuaauaaaacuauagagugugccugccgagauaacuccuacacagcgaagagaccauucgugaaacugaaugucgaaaccgacacugccgagaucagguuaaugugcacagagaccuaucuggauacgccccggccuaacgacggcagcauuaccggcccaugugaaucgaauggggauaagggaucugguggcaucaaagggggauuugugcaucaacguauggcauccaagauaggccgcugguacucaagaacaaugaguaaaacuaagaggauggguauggggcucuauguaaaguacgacggcgaccccuggaccgauagcgaggcucuugcccuguccggaguuauggugucuauggaggagccgggcugguacagcuucggguuugaaauuaaagacaagaaaugcgaugucccuuguaucggaaucgagauggugcacgacgguggcaagacaacuuggcauucagcugccaccgcaauuuauugcuugauggggaguggacagcuacugugggauacagugaccggcgucaacaugacucucuga

SEQ ID NO: 152051 - RNA, 1401 nt, Artificial Sequence; identical to SEQ ID NO: 150833
  derived and/or modified sequence opt3 from neuraminidase__InfluenzaB__AHL92402

SEQ ID NO: 152052 - RNA, 1401 nt, Artificial Sequence; identical to SEQ ID NO: 150833
  derived and/or modified sequence opt3 from neuraminidase__InfluenzaB__AHL92413

SEQ ID NO: 152053 - RNA, 1401 nt, Artificial Sequence; identical to SEQ ID NO: 150833
  derived and/or modified sequence opt3 from neuraminidase__InfluenzaB__AHL92424

SEQ ID NO: 152054 - RNA, 1401 nt, Artificial Sequence
  derived and/or modified sequence opt3 from neuraminidase__InfluenzaB__AHL92435
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcaucagcgagugccgguuucucaaaauucgcgaggguagaaucaucaaggaaauuuucccuacagggaggguuaagcacaccgaggaauguacgugcggauuugccaguaacaaaacuauagagugugcgugccgggauaauucuuacacagccaagcgcccauucgugaaacugaacgucgaaaccgacacugcagagauccgauuaaugugcacagagaccuaucuggauacgcccagaccuaaugacggcuccauuaccggcccaugugaaagcgauggggacaagggaucggguggcaucaaagggggauuugugcaucagaggauggcuucuaagauaggccggugguacucccguacaaugucaaaaacuaagcgcauggguauggggcucuauguaaaguacgacggcgaucccuggaccgacagugaggcccuugcucugagcggaguuaugauuuccauggaggaaccgggcugguacucuuucggguuugaaaucaaagauaagaaaugcgacgugccuuguaucggaauugagaugguccacgaugguggcaagacaacuuggcauagcgccgcaaccgccaucuauugcuugauggggucaggacagcuacugugggacacagugaccggcguggauauggcucucuga

SEQ ID NO: 152055 - RNA, 1401 nt, Artificial Sequence; identical to SEQ ID NO: 150833
  derived and/or modified sequence opt3 from neuraminidase__InfluenzaB__AHL92446

SEQ ID NO: 152056 - RNA, 1401 nt, Artificial Sequence; identical to SEQ ID NO: 150833
  derived and/or modified sequence opt3 from neuraminidase__InfluenzaB__AHL92457

SEQ ID NO: 152057 - RNA, 1401 nt, Artificial Sequence; identical to SEQ ID NO: 150833
  derived and/or modified sequence opt3 from neuraminidase__InfluenzaB__AHL92468

SEQ ID NO: 152058 - RNA, 1401 nt, Artificial Sequence; identical to SEQ ID NO: 150833
  derived and/or modified sequence opt3 from neuraminidase__InfluenzaB__AHL92479

SEQ ID NO: 152059 - RNA, 1401 nt, Artificial Sequence; identical to SEQ ID NO: 150804
  derived and/or modified sequence opt3 from neuraminidase__InfluenzaB__AHL92490

SEQ ID NO: 152060 - RNA, 1401 nt, Artificial Sequence; identical to SEQ ID NO: 150833
  derived and/or modified sequence opt3 from neuraminidase__InfluenzaB__AHL92501

SEQ ID NO: 152061 - RNA, 1401 nt, Artificial Sequence
  derived and/or modified sequence opt3 from neuraminidase__InfluenzaB__AHL92512
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacaugguggcuuggucaggcagugccugccaugauggccgggaauggacuuauaucgggguugacggaccggauagcaaugcgcugcuuaagauuaaauacggugaggcauacaccgacacauaucacucuuacgccaagaacauccugcgcacucaggaauccgcuuguaauugcauaggcggggauuguuauuugaugauuaccgacggacccgccucaggcaucagcgagugcagauuucucaaaauuagggagggucggaucaucaaggaaauuuucccuacagggcgcgugaagcacaccgaggaauguacgugcggauuugcaaguaacaaaacuauagagugugcuugccgagauaauucuuacacagccaagagaccauucgucaaacugaacguggaaaccgacacugcggagaucagguuaaugugcacagagaccuaucuggauacgccccggccuaaugacggcuccauuaccggcccaugugaaagcaacggggauaagggaucggguggcaucaaagggggauuuguacaucaacguauggccucuaagauaggccgcugguacuccagaacaaugucaaaaacuaagaggauggguauggggcucuauguuaaguacgacggcgaccccuggaccgauagugaggcacuugcucugagcggagugauggucuccauggaggaaccgggcugguacucuuucggguuugaaauuaaagacaagaaaugcgaugugccuuguaucggaaucgagauggugcacgacgguggcaagacaacuuggcauagcgccgcuaccgccauuuauugcuugauggggucaggacagcuacugugggauacagucaccggcguuaauaugacucucuga

SEQ ID NO: 152062 - RNA, 1401 nt, Artificial Sequence; identical to SEQ ID NO: 150833
  derived and/or modified sequence opt3 from neuraminidase__InfluenzaB__AHL92523

SEQ ID NO: 152063 - RNA, 1401 nt, Artificial Sequence; identical to SEQ ID NO: 150833
  derived and/or modified sequence opt3 from neuraminidase__InfluenzaB__AHL92534

SEQ ID NO: 152064 - RNA, 1401 nt, Artificial Sequence; identical to SEQ ID NO: 150804
  derived and/or modified sequence opt3 from neuraminidase__InfluenzaB__AHL92545

SEQ ID NO: 152065 - RNA, 1401 nt, Artificial Sequence; identical to SEQ ID NO: 150833
  derived and/or modified sequence opt3 from neuraminidase__InfluenzaB__AHL92556

SEQ ID NO: 152066 - RNA, 1401 nt, Artificial Sequence; identical to SEQ ID NO: 150833
  derived and/or modified sequence opt3 from neuraminidase__InfluenzaB__AHL92567

SEQ ID NO: 152067 - RNA, 1401 nt, Artificial Sequence; identical to SEQ ID NO: 150833
  derived and/or modified sequence opt3 from neuraminidase__InfluenzaB__AHL92578

SEQ ID NO: 152068 - RNA, 1401 nt, Artificial Sequence; identical to SEQ ID NO: 150804
  derived and/or modified sequence opt3 from neuraminidase__InfluenzaB__AHL92589

SEQ ID NO: 152069 - RNA, 1401 nt, Artificial Sequence; identical to SEQ ID NO: 150833
  derived and/or modified sequence opt3 from neuraminidase__InfluenzaB__AHL92600

SEQ ID NO: 152070 - RNA, 1401 nt, Artificial Sequence; identical to SEQ ID NO: 151860
  derived and/or modified sequence opt3 from neuraminidase__InfluenzaB__AHL92611

SEQ ID NO: 152071 - RNA, 1401 nt, Artificial Sequence
  derived and/or modified sequence opt3 from neuraminidase__InfluenzaB__AHL92622
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccuuccuccugccggaacccgaguggacauauccucggcugagcuguccagguaguaccuuucagaaggcccucuuaauuucuccccaccgcuucggcgaaacuaaaggaaauuccgcaccucugaucauucgagagccauuuaucgccugcgggcccaaggaauguaaacauuucgcucuuacacacuacgcagcccagccuggcgguuauuacaacgggacccgugaggacagaaauaaguugaggcaucugauaagcgugaagcuaggaaaaaucccaacggucgagaacuccauuuuucacauggcugccuggucaggcagugcgugccaugauggccgggaauggacuuauaucgggguggacggaccggauagcaaugcacuccugaagauuaaauacggugaggccuacaccgacacauaucacucuuacgcuaagaacauccuucgcacucaggaauccgccuguaauugcauaggcggggauuguuaucugaugauuaccgacggacccgcaucaggcaucagcgagugcagauucuugaaaauuagggagggucggaucaucaaggaaauuuuuccuacagggcgcguuaagcacaccgaggaauguacgugcggauucgcuaguaacaaaacuauagagugugccugccgagauaauucuuacacagcgaagagaccauuugugaaacucaacgucgaaaccgacacugccgagaucaggcugaugugcacagagaccuauuuagauacgccccggccuaaugacggcuccauuaccggcccaugugaaagcaacggggauaagggaucggguggcaucaaagggggauucgugcaucaacguauggcaucuaagauaggccgcugguacuccagaacaaugucaaaaacuaagaggauggguauggggcuguauguaaaguacgacggcgaccccuggaccgauagugaggcucucgcccuuagcggaguuaugguguccauggaggaaccgggcugguacucuuuuggguucgaaauuaaagacaagaaaugcgaugucccuuguaucggaaucgagauggugcacgacgguggcaagacaacuuggcauagcgcugccaccgcaauuuauugccugauggggucaggacaguugcuaugggauacagugaccggcgucaauaugacucuguga

SEQ ID NO: 152072 - RNA, 1401 nt, Artificial Sequence
  derived and/or modified sequence opt3 from neuraminidase__InfluenzaB__AHL92633
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccuuccuccugccggaacccgaguggacauauccucggcugagcuguccagguaguaccuuucagaaggcccucuuaauuucuccccaccgcuucggcgaaacuaaaggaaauuccgcaccucugaucauucgagagccauuuaucgccugcgggcccaaggaauguaaacauuucgcucuuacacacuacgcagcccagccuggcgguuauuacaacgggacccgugaggacagaaauaaguugaggcaucugauaagcgugaagcuaggaaaaaucccaauugucgagaacuccaucuuucacauggcugccuggucaggcagugcgugccaugauggccgggaauggacguauauugggguggacggaccggauagcaaugcacuccugaagaucaaauacggugaggccuacacugacaccuaucacucuuacgcuaagaacauacuucgcacacaggaauccgccuguaauugcauuggcggggauuguuaucugaugaucacugacggacccgcaucaggcauuagcgagugcagauucuugaaaaucagggagggucggaucauuaaggaaauauuuccuaccgggcgcguuaagcacacagaggaauguaccugcggauucgcuaguaacaaaacgaucgagugugccugccgagauaauucuuacacugcgaagagaccauuugugaaacucaacgucgaaacagacaccgccgagauuaggcugaugugcacugagacauauuuagauacgccccggccuaaugacggcuccaucaccggcccaugugaaagcaacggggauaagggaucggguggcauaaaagggggauucgugcaucaacguauggcaucuaagauuggccgcugguacuccagaaccaugucaaaaacaaagaggauggguauggggcuguauguaaaguacgacggcgaccccuggacugauagugaggcucucgcccuuagcggaguuaugguguccauggaggaaccgggcugguacucuuuuggguucgaaaucaaagacaagaaaugcgaugucccuuguaucggaauugagauggugcacgacgguggcaagaccacauggcauagcgcugccacugcaaucuauugccugauggggucaggacaguugcuaugggauaccgugacaggcgucaauaugacccuguga

SEQ ID NO: 152073 - RNA, 1401 nt, Artificial Sequence; identical to SEQ ID NO: 150804
  derived and/or modified sequence opt3 from neuraminidase__InfluenzaB__AHL92644

SEQ ID NO: 152074 - RNA, 1401 nt, Artificial Sequence; identical to SEQ ID NO: 150804
  derived and/or modified sequence opt3 from neuraminidase__InfluenzaB__AHL92655

SEQ ID NO: 152075 - RNA, 1401 nt, Artificial Sequence; identical to SEQ ID NO: 150833
  derived and/or modified sequence opt3 from neuraminidase__InfluenzaB__AHL92666

SEQ ID NO: 152076 - RNA, 1401 nt, Artificial Sequence; identical to SEQ ID NO: 150833
  derived and/or modified sequence opt3 from neuraminidase__InfluenzaB__AHL92677

SEQ ID NO: 152077 - RNA, 1401 nt, Artificial Sequence; identical to SEQ ID NO: 150804
  derived and/or modified sequence opt3 from neuraminidase__InfluenzaB__AHL92688

SEQ ID NO: 152078 - RNA, 1401 nt, Artificial Sequence; identical to SEQ ID NO: 150833
  derived and/or modified sequence opt3 from neuraminidase__InfluenzaB__AHL92699

SEQ ID NO: 152079 - RNA, 1401 nt, Artificial Sequence; identical to SEQ ID NO: 150833
  derived and/or modified sequence opt3 from neuraminidase__InfluenzaB__AHL92710

SEQ ID NO: 152080 - RNA, 1401 nt, Artificial Sequence; identical to SEQ ID NO: 150833
  derived and/or modified sequence opt3 from neuraminidase__InfluenzaB__AHL92721

SEQ ID NO: 152081 - RNA, 1401 nt, Artificial Sequence; identical to SEQ ID NO: 150833
  derived and/or modified sequence opt3 from neuraminidase__InfluenzaB__AHL92732

SEQ ID NO: 152082 - RNA, 1401 nt, Artificial Sequence; identical to SEQ ID NO: 150833
  derived and/or modified sequence opt3 from neuraminidase__InfluenzaB__AHL92743

SEQ ID NO: 152083 - RNA, 1401 nt, Artificial Sequence; identical to SEQ ID NO: 150833
  derived and/or modified sequence opt3 from neuraminidase__InfluenzaB__AHL92754

SEQ ID NO: 152084 - RNA, 1401 nt, Artificial Sequence; identical to SEQ ID NO: 150833
  derived and/or modified sequence opt3 from neuraminidase__InfluenzaB__AHL92765

SEQ ID NO: 152085 - RNA, 1401 nt, Artificial Sequence; identical to SEQ ID NO: 150833
  derived and/or modified sequence opt3 from neuraminidase__InfluenzaB__AHL92776

SEQ ID NO: 152086 - RNA, 1401 nt, Artificial Sequence; identical to SEQ ID NO: 150833
  derived and/or modified sequence opt3 from neuraminidase__InfluenzaB__AHL92787

SEQ ID NO: 152087 - RNA, 1401 nt, Artificial Sequence; identical to SEQ ID NO: 150833
  derived and/or modified sequence opt3 from neuraminidase__InfluenzaB__AHL92798

SEQ ID NO: 152088 - RNA, 1401 nt, Artificial Sequence
  derived and/or modified sequence opt3 from neuraminidase__InfluenzaB__AHL92809
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuauuaaaggaguaacucuccugcugccggaacccgaguggaccuauccucggcucagcuguccagguaguacauuccagaaggccuuacugaucucuccccaccgcuuuggcgaaaccaaaggaaauuccgcaccucuuauuauccgagagccauucauagccugcgggcccaaggaauguaaacauuuugcuuugacucacuacgcagcccagccuggcgguuauuacaacgggacacgugaggacagaaauaagcugaggcaucuaaucagcgugaagcucggaaaaauuccaaccgucgagaacuccaucuuccacauggcugccuggucaggcagugcgugccaugauggccgggaauggacguauauugggguggacggaccggauagcaaugcacugcuuaagaucaaauacggugaggccuacacugacaccuaucacucuuacgcuaagaacauacugcgcacacaggaauccgccuguaauugcauuggcggggauuguuauuugaugaucacugacggacccgcaucaggcauuagcgagugcagauuucucaaaaucagggagggucggaucauuaaggaaauauucccuaccgggcgcguuaagcacacagaggaauguaccugcggauuugcuaguaacaaaacgaucgagugugccugccgagauaauucuuacacugcgaagagaccauucgugaaacugaacgucgaaacagacaccgccgagauuagguuaaugugcacugagacauaucuggauacgccccggccuaaugacggcuccaucaccggcccaugugaaagcaacggggauaagggaucggguggcauaaaagggggauuugugcaucaacguauggcaucuaagauuggccgcugguacuccagaaccaugucaaaaacaaagaggauggguauggggcucuauguaaaguacgacggcgaccccuggacugauagugaggcucuugcccugagcggaguuaugguguccauggaggaaccgggcugguacucuuucggguuugaaaucaaagacaagaaaugcgaugucccuuguaucggaauugagauggugcacgacgguggcaagaccacauggcauagcgcugccacugcaaucuauugcuugauggggucaggacagcuacugugggauaccgugacaggcgucaauaugacccucuga

SEQ ID NO: 152089 - RNA, 1401 nt, Artificial Sequence
  derived and/or modified sequence opt3 from neuraminidase__InfluenzaB__AHL92820
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaacccuccugcugccggaacccgaguggacauauccucggcucagcuguccagguaguaccuuccagaaggccuuacugauuucuccccaccgcuuuggcgaaacuaaaggaaauuccgcaccucuuaucauucgagagccauucaucgccugcgggcccaaggaauguaaacauuuugcuuugacacacuacgcagcccagccuggcgguuauuacaacgggacccgugaggacagaaauaagcugaggcaucuaauaagcgugaagcucggaaaaaucccaacggucgagaacuccauuuuccacauggcugccuggucaggcagugcgugccaugauggccgggaauggacuuauaucgggguggacggaccggauagcaaugcacugcuuaagauuaaauacggugaggccuacaccgacacauaucacucuuacgcuaagaacauccugcgcacucaggaauccgccuguaauugcauaggcggggauuguuauuugaugauuaccgacggacccgcaucaggcaucagcgagugcagauuucucaaaauuagggagggucggaucaucaaggaaauuuucccuacagggcgcguuaagcacaccgaggaauguacgugcggauuugcuaguaacaaaacuauagagugugccugccgagauaauucuuacacagcgaagagaccauucgugaaacugaacgucgaaaccgacacugccgagaucagguuaaugugcacagagaccuaucuggauacgccccggccuaaugacggcuccauuaccggcccaugugaaagcaacggggauaagggaucggguggcaucaaagggggauuugugcaucaacguauggcaucuaagauaggccgcugguacuccagaacaaugucaaaaacuaagaggauggguauggggcucuauguaaaguacgacggcgaccccuggaccgauagugaggcucuugcccugagcggaguuaugguguccauggaggaaccgggcugguacucuuucggguuugaaauuaaagacaagaaaugcgaugucccuuguaucggaaucgagauggugcacgacgguggcaagaaaacauggcauagcgcugccacugcaauuuauugcuugauggggucaggacagcuacugugggauaccgugacaggcgucaauaugacccucuga

SEQ ID NO: 152090 - RNA, 1401 nt, Artificial Sequence
  derived and/or modified sequence opt3 from neuraminidase__InfluenzaB__AHL92842
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucaacuaccaaaggaguaacacuccugcugccggaacccgaguggaccuauccucggcucagcuguccagguaguacuuuccagaaggcuuuacugauuucuccccaccgcuuuggcgaaacaaaaggaaauuccgccccucuuaucauucgagagccauucaucgcaugcgggcccaaggaauguaaacauuuugccuugacccacuacgcugcacagccuggcgguuauuacaacgggacgcgugaggacagaaauaagcugaggcaucuaauaagcgugaagcucggaaaaaucccaacugucgagaacuccauuuuccacauggccgcuuggucaggcagugccugccaugauggccgggaauggaccuauaucgggguggacggaccggauagcaaugcgcugcuuaagauuaaauacggugaggcauacacagacacuuaucacucuuacgccaagaacauccugcgcacccaggaauccgcuuguaauugcauaggcggggauuguuauuugaugauuacagacggacccgccucaggcaucagcgagugcagauuucucaaaauuagggagggucggaucaucaaggaaauuuucccuaccgggcgcguuaagcacacggaggaauguacuugcggauuugcaaguaacaaaacaauagagugugcuugccgagauaauucuuacaccgccaagagaccauucgugaaacugaacgucgaaacugacacagcggagaucagguuaaugugcaccgagacguaucuggauacaccccggccuaaugacggcuccauuaccggcccaugugaaagcaacggggauaagggaucggguggcaucaaagggggauuugugcaucaacguauggccucuaagauaggccgcugguacuccagaacuaugucaaaaaccaagaggauggguauggggcucuauguaaaguacgacggcgaccccuggacagauagugaggcacuugcucugagcggaguuaugguguccauggaggaaccgggcugguacucuuucggguuugaaauuaaagacaagaaaugcgaugucccuuguaucggaaucgagauggugcacgacgguggcaagacuaccuggcauagcgccgcuacagccauuuauugcuugauggggucaggacagcuacugugggauaccgugacuggcgucaauaugacgcucuga

SEQ ID NO: 152091 - RNA, 1401 nt, Artificial Sequence; identical to SEQ ID NO: 150833
  derived and/or modified sequence opt3 from neuraminidase__InfluenzaB__AHL92853

SEQ ID NO: 152092 - RNA, 1401 nt, Artificial Sequence; identical to SEQ ID NO: 150833
  derived and/or modified sequence opt3 from neuraminidase__InfluenzaB__AHL92864

SEQ ID NO: 152093 - RNA, 1401 nt, Artificial Sequence; identical to SEQ ID NO: 150686
  derived and/or modified sequence opt3 from neuraminidase__InfluenzaB__AHL92875

SEQ ID NO: 152094 - RNA, 1401 nt, Artificial Sequence; identical to SEQ ID NO: 150643
  derived and/or modified sequence opt3 from neuraminidase__InfluenzaB__AHL92886

SEQ ID NO: 152095 - RNA, 1401 nt, Artificial Sequence
  derived and/or modified sequence opt3 from neuraminidase__InfluenzaB__AHL92897
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaucccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugauuuccccucaccgguuuggcgaaacaaaaggaaauucugcaccacuuaucauucgcgagcccuucaucgccugcgggccuaacgaauguaagcauuuugcuuugacccacuacgcagcccagccaggcgguuauuacaaugggacgcgaggagaccguaacaaacugagacaucuaauaagcgugaagcucggcaagaucccgacugucgaaaauuccauuuuccacauggcugccuggucaggcagugcgugccaugaugggaaagaguggaccuauaucggaguggacggucccgauaacaaugcacugcuuaagauuaaauacggcgaggccuacacagacacuuaucacagcuacgcuaacaauauccugaggacccaggagucugccuguaacugcauagggggaaauuguuauuugaugauuacagauggcuccgcaucagguguuagcgaaugccgguuucucaagauccgcgaggggagaauuaucaaagagaucuucccuaccggaagggugaagcacacggaagaguguacuugcggcuuugcuaguaacaagacaauugaaugugccugccgggacaauucuuacaccgcgaaacgcccauucgucaagcugaacguggagacugauacagccgaaauacgauuaaugugcaccgacacguaucuggauacccccagaccugacgauggcuccaucacagggccaugugagagcaacggagacaaagguucgggcgggauuaagggaggcuuuguacaucaaaggauggcaucuaaaaucggucggugguacucccguacuaugucaaagaccgagcgcauggggaugggccucuauguuaaauacgacggagaucccugggcugacagugaugcccuugcuuucagcggcgugauggucuccaugaaggaaccggggugguacucuuuuggauucgagauaaaggacaaaaagugcgaugugccuuguauugguaucgaaauggugcacgacggcgggaaagagacauggcauagcgccgcaacugccaucuauugccugaugggaucaggccaguugcuaugggauaccgucacagguguugacauggcucuguga

SEQ ID NO: 152096 - RNA, 1401 nt, Artificial Sequence
  derived and/or modified sequence opt3 from neuraminidase__InfluenzaB__AHL92908
augcugcccagcaccauccagacacucacucuuuuccugacguugggcgggguguuacugucccuauacgucucugccucacucaguuaucugcuuuacagcgacauucuguugaaguuuucccaaaccgagauaacagcuccuaucaugccacucgauugcgcaaacgccucuaauguucaggcggugaacagaucggcuacuaaaggaguaacccugcugcucccggaacccgaguggacauauccuagguuaucauguccagguagcaccuuccagaaggcccugcuuauuaguccccaccgguuuggcgaaacuaaaggaaauuccgcaccuuugaucauucgcgagccauucaucgccugcgggcccaaggaauguaaacauuuugcucugacacacuacgcagcccagccuggcgguuauuacaacgggacccgagaggaccguaauaagcuaagacaucucauaucugugaagcugggaaaaaucccaacggucgagaacagcauuuuccacauggcugccugguccggcucagcgugccaugauggcaaggaauggacuuauaucgggguggacggaccggauaguaaugcacuucugaaaauuaaguacggugaggccuacaccgacacauaucacagcuacgcuaaaaacaucuugaggacucaagaaucugccuguaauugcauaggcggggauuguuaucucaugauuaccgacggacccgcauccggcaucucagagugccgguuucugaagauucgcgaggguagaaucaucaaggaaauuuucccuacagggaggguuaaacacaccgaggaauguacgugcggauuugcuagcaacaagacuauagagugugccugccgggauaauaguuacacagcgaaacgcccauucgugaaguuaaacgucgaaaccgacacugccgagauccgacugaugugcacagagaccuaucucgauacgcccagaccuaaugacggcucuauuaccggcccaugugaauccaacggggauaaaggaagcgguggcaucaaagggggauuugugcaucagaggauggcaucgaagauaggccggugguacucucguacaauguccaagacuaagcgcauggguauggggcuuuauguaaaauacgacggcgaccccuggaccgauucagaggcucuggccuugaguggaguuauggugagcauggaggaaccgggcugguacuccuucggguuugaaauuaaggacaaaaagugcgaugucccuuguaucggaaucgagauggugcacgacgguggcaaaacaacuuggcauucugcugccaccgcaguguauugccuaauggggagcggacagcugcucugggauacaauuaccggcgucgacauggcccuguga

SEQ ID NO: 152097 - RNA, 1401 nt, Artificial Sequence
  derived and/or modified sequence opt3 from neuraminidase__InfluenzaB__AHL92919
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaaucgacggucccgauaacaaugcacugcuuaagauuaaauacggcgaggccuacacagacacuuaucacagcuacgcuaacaauauccugaggacccaggagucugccuguaacugcauagggggaaauuguuauuugaugauuacagauggcuccgcaucaggugugagcgaaugccgguuucucaagauccgcgaggggagaauuaucaaagagaucuucccuaccggaaggguuaagcacacggaagaguguacuugcggcuuugcuaguaacaagacaauugaaugugccugccgggacaauucuuacaccgcgaaacgcccauucgugaagcugaacgucgagacugauacagccgaaauacgauuaaugugcaccgacacguaucuggauacccccagaccugacgauggcuccaucacagggccaugugagagcaacggagacaaagguucgggcgggauuaagggaggcuuugugcaucaaaggauggcaucuaaaaucggucggugguacucccguacuaugucaaagaccgagcgcauggggaugggccucuauguaaaauacgacggagaucccugggcugacagugaugcccuugcuuucagcggcguuaugguguccaugaaggaaccggggugguacucuuuuggauucgagauaaaggacaaaaagugcgaugucccuuguauugguaucgaaauggugcacgacggcgggaaagagacauggcauagcgccgcaacugccaucuauugccugaugggaucaggccaguugcuaugggauaccgugacaggugucgacauggcucuguga

SEQ ID NO: 152098 - RNA, 1401 nt, Artificial Sequence
  derived and/or modified sequence opt3 from neuraminidase__InfluenzaB__AHL92930
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacgacgcacugcuuaagaucaaauacggcgaggccuacacagauacuuaucacagcuacgcuaauaacauucugaggacccaggagucugccuguaauugcaucgggggaaacuguuauuugaugauaacagacggcuccgcaucagguguuagcgaaugccgguuucucaagauucgcgaggggagaaucauuaaagagaucuucccuaccggaagggugaagcacacggaagaguguacuugcggcuuugcuaguaauaagacaaucgaaugugccugccgggauaacucuuacaccgcgaaacgcccauucgucaagcuggacguggagacugauacagccgaaauucgauuaaugugcaccgacacguaucuggauacccccagaccugacgacggcuccauaacagggccaugugagagcaauggagauaaagguucgggcgggaucaagggaggcuuuguacaucaaaggauggcaucuaaaauuggucggugguacucccguacuaugucaaagaccgagcgcauggggaugggccucuauguuaaauacgacggagaucccugggcugacagugaugcccuugcuuucagcggcgugauggucuccaugaaggaaccggggugguacucuuuuggauucgagaucaaggacaaaaagugcgaugugccuuguauagguauugaaauggugcacgacggcgggaaagagacauggcauagcgccgcaacugccaucuauugccugaugggaucaggccaguugcuaugggauaccgucacagguguugacauggcucuguga

SEQ ID NO: 152099 - RNA, 1401 nt, Artificial Sequence; identical to SEQ ID NO: 150643
  derived and/or modified sequence opt3 from neuraminidase__InfluenzaB__AHL92941

SEQ ID NO: 152100 - RNA, 1401 nt, Artificial Sequence; identical to SEQ ID NO: 150651
  derived and/or modified sequence opt3 from neuraminidase__InfluenzaB__AHL92952

SEQ ID NO: 152101 - RNA, 1401 nt, Artificial Sequence; identical to SEQ ID NO: 150651
  derived and/or modified sequence opt3 from neuraminidase__InfluenzaB__AHL92963

SEQ ID NO: 152102 - RNA, 1401 nt, Artificial Sequence
  derived and/or modified sequence opt3 from neuraminidase__InfluenzaB__AHL92974
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucacgcggugaacagaucagcuaccaaaggaguaacacuccugcugcccgaaccugaguggaccuauccaaggcucagcugucccgguaguacuuuccaaaaggccuuacugaucuccccucaucgguuuggcgaaacaaaaggaaauucugcaccacuuauuauccgcgagcccuucauugccugcgggccuaacgaauguaagcacuuugcuuugacccauuacgcagcccagccaggcgguuauuacaaugggacgcgaggagaccguaacaaacugagacaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagaucaaauacggcgaggccuacacagacacuuaucacagcuacgcuaacaauauucugaggacccaggagucugccuguaacugcaucgggggaaauuguuauuugaugauaacagauggcuccgcaucagguguuagcgaaugccgguuucucaagauucgcgaggggagaaucauuaaagagaucuucccuaccggaagggugaagcauacggaagaguguacuugcggcuuugcuaguaacaagacaaucgaaugugccugccgggacaauucuuacaccgcgaaacgcccauucgucaagcugaacguggagacugauacagccgaaauucgauuaaugugcaccgacacguaucuggauacccccagaccugacgauggcuccauaacagggccaugugagagcaacggagacaaagguucgggcgggaucaagggaggcuuuguacaccagaggauggcaucuaaaauuggucggugguacucccguacuaugucaaagaccgagcgcauggggaugggccucuauguuaaauacaauggagaccccugggcugauagugacgcccuugcuuucagcggcgugauggucuccaugaaggaaccggggugguacucuuuuggauucgagaucaaggauaaaaagugcgacgugccuuguauagguauugaaauggugcaugauggcgggaaagagacauggcacagcgccgcaacugccaucuauugccugaugggaucaggccaauugcuaugggacaccgucacagguguugauauggcucuguga

SEQ ID NO: 152103 - RNA, 1401 nt, Artificial Sequence; identical to SEQ ID NO: 150651
  derived and/or modified sequence opt3 from neuraminidase__InfluenzaB__AHL92985

SEQ ID NO: 152104 - RNA, 1401 nt, Artificial Sequence; identical to SEQ ID NO: 150651
  derived and/or modified sequence opt3 from neuraminidase__InfluenzaB__AHL92996

SEQ ID NO: 152105 - RNA, 1401 nt, Artificial Sequence; identical to SEQ ID NO: 152024
  derived and/or modified sequence opt3 from neuraminidase__InfluenzaB__AHL93008

SEQ ID NO: 152106 - RNA, 1401 nt, Artificial Sequence; identical to SEQ ID NO: 152033
  derived and/or modified sequence opt3 from neuraminidase__InfluenzaB__AHL93019

SEQ ID NO: 152107 - RNA, 1401 nt, Artificial Sequence; identical to SEQ ID NO: 152033
  derived and/or modified sequence opt3 from neuraminidase__InfluenzaB__AHL93030

SEQ ID NO: 152108 - RNA, 1401 nt, Artificial Sequence; identical to SEQ ID NO: 152047
  derived and/or modified sequence opt3 from neuraminidase__InfluenzaB__AHL93041

SEQ ID NO: 152109 - RNA, 1401 nt, Artificial Sequence; identical to SEQ ID NO: 152047
  derived and/or modified sequence opt3 from neuraminidase__InfluenzaB__AHL93052

SEQ ID NO: 152110 - RNA, 1401 nt, Artificial Sequence; identical to SEQ ID NO: 150833
  derived and/or modified sequence opt3 from neuraminidase__InfluenzaB__AHL93063

SEQ ID NO: 152111 - RNA, 1401 nt, Artificial Sequence; identical to SEQ ID NO: 150833
  derived and/or modified sequence opt3 from neuraminidase__InfluenzaB__AHL93074

SEQ ID NO: 152112 - RNA, 1401 nt, Artificial Sequence; identical to SEQ ID NO: 150833
  derived and/or modified sequence opt3 from neuraminidase__InfluenzaB__AHL93085

SEQ ID NO: 152113 - RNA, 1401 nt, Artificial Sequence; identical to SEQ ID NO: 152090
  derived and/or modified sequence opt3 from neuraminidase__InfluenzaB__AHL93096

SEQ ID NO: 152114 - RNA, 1401 nt, Artificial Sequence; identical to SEQ ID NO: 150833
  derived and/or modified sequence opt3 from neuraminidase__InfluenzaB__AHL93107

SEQ ID NO: 152115 - RNA, 1401 nt, Artificial Sequence; identical to SEQ ID NO: 150833
  derived and/or modified sequence opt3 from neuraminidase__InfluenzaB__AHL93118

SEQ ID NO: 152116 - RNA, 1401 nt, Artificial Sequence; identical to SEQ ID NO: 150804
  derived and/or modified sequence opt3 from neuraminidase__InfluenzaB__AHL93129

SEQ ID NO: 152117 - RNA, 1401 nt, Artificial Sequence; identical to SEQ ID NO: 150833
  derived and/or modified sequence opt3 from neuraminidase__InfluenzaB__AHL93140

SEQ ID NO: 152118 - RNA, 1401 nt, Artificial Sequence; identical to SEQ ID NO: 150804
  derived and/or modified sequence opt3 from neuraminidase__InfluenzaB__AHL93151

SEQ ID NO: 152119 - RNA, 1401 nt, Artificial Sequence; identical to SEQ ID NO: 150833
  derived and/or modified sequence opt3 from neuraminidase__InfluenzaB__AHL93162

SEQ ID NO: 152120 - RNA, 1401 nt, Artificial Sequence; identical to SEQ ID NO: 150833
  derived and/or modified sequence opt3 from neuraminidase__InfluenzaB__AHL93173

SEQ ID NO: 152121 - RNA, 1401 nt, Artificial Sequence; identical to SEQ ID NO: 150804
  derived and/or modified sequence opt3 from neuraminidase__InfluenzaB__AHL93184

SEQ ID NO: 152122 - RNA, 1401 nt, Artificial Sequence; identical to SEQ ID NO: 150833
  derived and/or modified sequence opt3 from neuraminidase__InfluenzaB__AHL93195

SEQ ID NO: 152123 - RNA, 1401 nt, Artificial Sequence; identical to SEQ ID NO: 150833
  derived and/or modified sequence opt3 from neuraminidase__InfluenzaB__AHL93206

SEQ ID NO: 152124 - RNA, 1401 nt, Artificial Sequence; identical to SEQ ID NO: 150977
  derived and/or modified sequence opt3 from neuraminidase__InfluenzaB__AHL93217

SEQ ID NO: 152125 - RNA, 1401 nt, Artificial Sequence; identical to SEQ ID NO: 150977
  derived and/or modified sequence opt3 from neuraminidase__InfluenzaB__AHL93228

SEQ ID NO: 152126 - RNA, 1401 nt, Artificial Sequence
  derived and/or modified sequence opt3 from neuraminidase__InfluenzaB__AHL93239
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuauugccugcgggccuaacgaauguaagcauuucgcucuuacccacuacgcagcccagccaggcgguuauuacaaugggacgcgaggagaccguaacaaauugagacaucugaucagcgugaagcuaggcaagauaccgacugucgaaaauuccaucuuucacauggcugccuggucaggcagugcgugccaugaugggaaagaguggaccuauauuggaguggacggucccgauaacaaugcacuccugaagguuaaauacggcgaggccuacacagacacuuaucacagcuacgcuaacaagauccuuaggacccaggagucugccuguaauugcauugggggaaacuguuaucugaugaucacagauggcuccgcaucaggugugagcgaaugccgguucuugaaaauacgcgaggggagaauuaucaaggagauuuuuccuaccggaagggucaagcacacggaagaguguacuugcggcuucgcuaguaauaaaacaaucgaaugugccugccgggacaacucuuacaccgcgaagcgcccauuugugaaacucaauguagagacugauacagccgaaauccgacugaugugcaccgacacguauuuagauacccccagaccugacgauggcuccauuacagggccaugugagagcaacggagacaaggguucgggcgggauaaaaggaggcuucguucaucaaaggauggagucuaagaucggucggugguacucccguacuaugucaaaaaccgaacgcauggggaugggccuguaugugaaguacgacggagaucccugggcagacagugaugcucucgccuuuagcggcgucaugguguccaugaaggagccggggugguacucuuucggauucgaaauuaaagacaagaaaugcgaugugccuuguaucgguauagagaugguccacgacggcgggaaggaaacauggcauagcgcugccacugcaauuuauugccuuaugggaucaggccagcuguugugggauaccguuacagguguggacauggcccuauga

SEQ ID NO: 152127 - RNA, 1401 nt, Artificial Sequence
  derived and/or modified sequence opt3 from neuraminidase__InfluenzaB__AHL93250
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcauggggaugggccuguauguuaaauacgacggagaucccuggaccgacagugaugcucucgccuuuagaggcgugauggucagcaugaaggaaccggggugguacuccuucggauucgagaucaaggacaaaaagugcgaugugccuuguauagguauugaaauggugcaugacggcgggaaagagacauggcacucugcugccacugcaaucuauugccuuaugggaagcggccaacuguugugggauaccgucacagguguugacauggcccuauga

SEQ ID NO: 152128 - RNA, 1401 nt, Artificial Sequence; identical to SEQ ID NO: 150977
  derived and/or modified sequence opt3 from neuraminidase__InfluenzaB__AHL93261

SEQ ID NO: 152129 - RNA, 1401 nt, Artificial Sequence; identical to SEQ ID NO: 150977
  derived and/or modified sequence opt3 from neuraminidase__InfluenzaB__AHL93272

SEQ ID NO: 152130 - RNA, 1401 nt, Artificial Sequence; identical to SEQ ID NO: 150977
  derived and/or modified sequence opt3 from neuraminidase__InfluenzaB__AHL93283

SEQ ID NO: 152131 - RNA, 1401 nt, Artificial Sequence; identical to SEQ ID NO: 150977
  derived and/or modified sequence opt3 from neuraminidase__InfluenzaB__AHL93294

SEQ ID NO: 152132 - RNA, 1401 nt, Artificial Sequence
  derived and/or modified sequence opt3 from neuraminidase__InfluenzaB__AHL93305
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucguggccugcgggccuaacgaauguaagcauuuugcuuugacccacuacgcagcccagccaggcgguuauuacaaugggacgcgaggagaccguaacaaacugagacaucuaauuagcgucaagcucggcaagaucccgacuguggaaaauuccauauuccacauggcugccuggucaggcagugcgugccaugaugggaaagaguggaccuauaucggaguugacggucccgauaacaaugcacugcuuaaggugaaauacggcgaggccuacacagacacuuaucacagcuacgcuaacaagauucugaggacccaggagucugccuguaauugcaucgggggaaacuguuauuugaugauuacagauggcuccgcaucaggugucagcgaaugccgguuucucaaaauccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaaauccgauuaaugugcaccgacacguaucuggauacccccagaccuaacgacggcuccaucacagggccaugugagagcaacggagauaaggguucgggcgggauuaaaggaggcuuugugcaucaaaggauggagucuaagauaggucggugguacucccguacuaugucaaaaaccgaacgcauggggaugggccucuaugucaaguacgacggagaccccugggcagauagugacgcucuugccuucagcggcgugaugguguccaugaaggagccggggugguacucuuuuggauucgaaaucaaagauaagaaaugcgacgucccuuguauugguaucgagaugguucacgauggcgggaaggaaacauggcauagcgcugccacugcaauauauugccugaugggaucaggccaguugcuaugggacaccgugacagguguagauauggcccuguga

SEQ ID NO: 152133 - RNA, 1401 nt, Artificial Sequence; identical to SEQ ID NO: 150977
  derived and/or modified sequence opt3 from neuraminidase__InfluenzaB__AHL93316

SEQ ID NO: 152134 - RNA, 1401 nt, Artificial Sequence
  derived and/or modified sequence opt3 from neuraminidase__InfluenzaB__AHL93338
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugaugccgcagaaauccgauuaaugugcacagacaccuaucuggauacgcccagaccuaacgacggcuccauuaccgggccaugugagagcaacggagauaaggguucgggcgggauaaaaggaggcuuuguucaucaaaggauggagucuaagaucggucggugguacucccguacaaugucaaaaacugaacgcauggggaugggccucuaugugaaguacgacggagaccccugggcugauagugacgcccuugcuuucagcggcgucaugguguccaugaaggagccggggugguacucuuuuggauucgaaauuaaagauaagaaaugcgacgugccuuguaucgguauagagaugguccacgauggcgggaaggaaaccuggcauagcgccgcaacagccauuuauugccugaugggaucaggccaguugcuaugggacacuguuaccgguguggauauggcucuguga

SEQ ID NO: 152135 - RNA, 1401 nt, Artificial Sequence
  derived and/or modified sequence opt3 from neuraminidase__InfluenzaB__AHL93349
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucaggguaguacuuuccagaaggccuuacugaucucuccccaccgguuuggcgaaacaaaaggaaauuccgcaccucuuauuauccgcgagccauucauugccugcgggcccaacgaauguaagcauuuugcuuugacccacuacgcagcccagccuggcgguuauuacaaugggacgcgaggagaccguaacaaacugagacaucuaaucagcgugaagcucggcaagauaccaacugucgaaaauuccaucuuccacauggcugccuggucaggcagugcgugccaugaugggaaagaguggaccuauauuggaguggacgguccggauaacaaugcacugcuuaagguuaaauacggcgaggccuacacagacacuuaucacagcuacgcuaacaagauccugaggacccaagagucugccuguaauugcauugggggaaacuguuauuugaugaucacagauggcuccgcaucaggugugagcgaaugccgguuucucaaaauacgcgaggggagaauuaucaaggagauuuuccccaccggaagggucaagcacacggaagaguguacuugcggcuuugcuaguaauaaaacaaucgaaugugccugccgggacaacucuuacaccgcgaagcgcccuuucgugaaacugaauguagagacugauacagccgaaauccgauuaaugugcaccgacacguaucuggauaccccaagacccaacgacggcuccauuacagggccuugugagagcaacggagauaaggguucgggcgggauaaaaggaggcuuuguucaucagaggauggagucuaagaucggucggugguacucccguacuaugucaaaaaccgaacgcauggggauggagcucuaugugaaguacgacggcgacccaugggcagauagugacgcucuugccuucagcggagucaugguguccaugaaggaacccggcugguacucuuuuggguucgagauuaaagauaagaaaugcgacgugccguguaucggaauagaaaugguccacgaugguggcaaggagacauggcauagcgcugccacugcaauuuauugccugauggggucaggacaguugcuaugggacaccguuacaggcgugaauauggcccuguga

SEQ ID NO: 152136 - RNA, 1401 nt, Artificial Sequence; identical to SEQ ID NO: 150977
  derived and/or modified sequence opt3 from neuraminidase__InfluenzaB__AHL93371

SEQ ID NO: 152137 - RNA, 1401 nt, Artificial Sequence
  derived and/or modified sequence opt3 from neuraminidase__InfluenzaB__AHL93382
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggauggagcucuaugugaaguacgacggcgaccccugggcagauagugacgcucuugccuucagcggagucaugguguccaugaaggaaccgggcugguacucuuuuggguucgagauuaaagauaagaaaugcgacgugccuuguaucggaauagaaaugguccacgaugguggcaaggagacauggcauagcgcugccacugcaauuuauugccugauggggucaggacaguugcuaugggacaccguuacaggcgugaauauggcccuguga

SEQ ID NO: 152138 - RNA, 1401 nt, Artificial Sequence; identical to SEQ ID NO: 150977
  derived and/or modified sequence opt3 from neuraminidase__InfluenzaB__AHL93393

SEQ ID NO: 152139 - RNA, 1401 nt, Artificial Sequence; identical to SEQ ID NO: 150977
  derived and/or modified sequence opt3 from neuraminidase__InfluenzaB__AHL93404

SEQ ID NO: 152140 - RNA, 1401 nt, Artificial Sequence; identical to SEQ ID NO: 150977
  derived and/or modified sequence opt3 from neuraminidase__InfluenzaB__AHL93415

SEQ ID NO: 152141 - RNA, 1401 nt, Artificial Sequence; identical to SEQ ID NO: 150977
  derived and/or modified sequence opt3 from neuraminidase__InfluenzaB__AHL93426

SEQ ID NO: 152142 - RNA, 1401 nt, Artificial Sequence; identical to SEQ ID NO: 150977
  derived and/or modified sequence opt3 from neuraminidase__InfluenzaB__AHL93437

SEQ ID NO: 152143 - RNA, 1401 nt, Artificial Sequence; identical to SEQ ID NO: 152137
  derived and/or modified sequence opt3 from neuraminidase__InfluenzaB__AHL93448

SEQ ID NO: 152144 - RNA, 1404 nt, Artificial Sequence
  derived and/or modified sequence opt3 from neuraminidase__InfluenzaB__AHL93459
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcuccccgaaccugaguggaccuauccaagguuaagcugucccgguaguacuuuccagaaggcccugcuuaucuccccucaccgguuuggcgaaacaaaaggaaauucugcaccauugauuauccgcgagcccuucauugccugcgggccuaacgaauguaagcauuuugcucugacccacuacgcagcccagccaggcgguuauuacaaugggacgcgaggagaccguaacaaacuaagacaucucaucagcgugaagcugggcaagauaccgacugucgaaaauuccaucuuccacauggcugccuggucaggcagugcgugccaugaugggaaagaguggaccuauauuggaguggacggucccgauaacaaugcacuucugaagguuaaauacggcgaggccuacacagacacuuaucacagcuacgcuaacaagaucuugaggacccaggagucugccuguaauugcauugggggaaacuguuaucucaugaucacagauggcuccgcaucaggugugagcgaaugccgguuucugaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaauuaaauguagagacugauacagccgaaauccgacugaugugcaccgacacguaucucgauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccuuuaugugaaguacgacggagaccccugggcagauagugacgcucuggccuucagcggcgucaugguguccaugaaggagccggggugguacucuuuuggauucgaaauuaaagauaagaaaugcgacgugccuuguaucgguauagagaugguccacgauggcgggaaggaaacauggcauagcgcugccacugcaauuuauugcuugaugggaucaggccagcuacugugggacaccguuacagguguggauauggcccucuga

SEQ ID NO: 152145 - RNA, 1401 nt, Artificial Sequence
  derived and/or modified sequence opt3 from neuraminidase__InfluenzaB__AHL93470
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccucuaugugaaguacgacggagaccccugggcagauagugacgcucuuacauucagcggcgucaugguguccaugaaggagccggggugguacucuuuuggauucgaaauuaaagauaagaaaugcgacgugccuuguaucgguauagagaugguccacgauggcgggaaggaaacuuggcauagcgccgcuaccgccauuuauugccugaugggaucaggccaguugcuaugggacacaguuaccgguguggauauggcacuguga

SEQ ID NO: 152146 - RNA, 1401 nt, Artificial Sequence; identical to SEQ ID NO: 150914
  derived and/or modified sequence opt3 from neuraminidase__InfluenzaB__AHL93481

SEQ ID NO: 152147 - RNA, 1401 nt, Artificial Sequence; identical to SEQ ID NO: 150972
  derived and/or modified sequence opt3 from neuraminidase__InfluenzaB__AHL93492

SEQ ID NO: 152148 - RNA, 1401 nt, Artificial Sequence; identical to SEQ ID NO: 150833
  derived and/or modified sequence opt3 from neuraminidase__InfluenzaB__AHL93503

SEQ ID NO: 152149 - RNA, 1401 nt, Artificial Sequence
  derived and/or modified sequence opt3 from neuraminidase__InfluenzaB__AHL93514
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcauaaagcucggcaagaucccgacuguggaaaauuccauuuuccacauggcugccuggucaggcagugcgugccaugaugggaaagaguggaccuauaucggagucgacggucccgauaacaaugcacugcuuaaggugaaauacggcgaggccuacacagacacuuaucacagcuacgcuaacaagauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauucgauuaaugugcaccgacacguaucuggauacccccagaccugacgauggcuccauaacagggagcugugagucgaacggagacaaggguucuggcgggaucaaaggaggcuuuguacaucaaaggauggaguccaagauuggucggugguacucacguacuaugaguaaaaccgaacgcauggggaugggccucuauguuaaguacgacggagauccaugggcagacagcgaugcucuuacauucuccggcgugauggucucuaugaaggagcccgggugguacagcuuuggauucgaaaucaaagacaagaaaugcgaugugccguguauagguauugagauggugcacgacggcgggaaggaaacuuggcauucagccgcuaccgccaucuauugccugaugggaaguggccaguugcuaugggauacagucaccgguguugacauggcacuguga

SEQ ID NO: 152150 - RNA, 1401 nt, Artificial Sequence; identical to SEQ ID NO: 150833
  derived and/or modified sequence opt3 from neuraminidase__InfluenzaB__AHL93525

SEQ ID NO: 152151 - RNA, 1401 nt, Artificial Sequence; identical to SEQ ID NO: 150972
  derived and/or modified sequence opt3 from neuraminidase__InfluenzaB__AHL93536

SEQ ID NO: 152152 - RNA, 1401 nt, Artificial Sequence
  derived and/or modified sequence opt3 from neuraminidase__InfluenzaB__AHL93558
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaagggucaagcacaccgaagaguguacgugcggcuuugccaguaauaaaacuaucgaaugugcgugccgggacaacucuuacacagccaagcgcccauucgugaaacugaauguagagaccgauacugcagaaauccgauuaaugugcacagacaccuaucuggauacgcccagaccuaacgacggcuccauuaccgggccaugugagagcgauggagacaaggguucgggcgggauaaaaggaggcuuuauccaucaaaggauggagucuaagauuggucggugguacucccguacaaugucaaaaacugaacgcauggggaugggccucuauguuaaguacgacggagaucccugggcugacagugaugcccuugcuuucagcggcgugauggucuccaugaaggagccggggugguacucuuuuggauucgaaaucaaagacaagaaaugcgaugugccuuguauagguauugagauggugcacgacggcgggaaggaaaccuggcauagcgccgcaacagccaucuauugccugaugggaucaggccaguugcuaugggauacugucaccgguguugacauggcucuguga

SEQ ID NO: 152153 - RNA, 1401 nt, Artificial Sequence
  derived and/or modified sequence opt3 from neuraminidase__InfluenzaB__AHL93569
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccugggcagacagugaugcucuuacauucagcggcgucaugguguccaugaaggagccggggugguacucuuuuggauucgaaauuaaagacaagaaaugcgaugugccuuguaucgguauagagaugguccacgacggcgggaaggaaacuuggcauagcgccgcuaccgccauuuauugccugaugggaucaggccaguugcuaugggauacaguuaccgguguggacauggcacuguga

SEQ ID NO: 152154 - RNA, 1401 nt, Artificial Sequence; identical to SEQ ID NO: 150972
  derived and/or modified sequence opt3 from neuraminidase__InfluenzaB__AHL93580

SEQ ID NO: 152155 - RNA, 1401 nt, Artificial Sequence; identical to SEQ ID NO: 150972
  derived and/or modified sequence opt3 from neuraminidase__InfluenzaB__AHL93591

SEQ ID NO: 152156 - RNA, 1401 nt, Artificial Sequence
  derived and/or modified sequence opt3 from neuraminidase__InfluenzaB__AHL93613
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugauggugacagauggcuccgcaucaggugucagcgaaugccgguuucucaaaauccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaaauccgauuaaugugcaccgacacguaucuggauacccccagaccugacgauggcuccaucacagggccaugugagagcaacggagacaaggguucgggcgggauuaaaggaggcuuugugcaucaaaggauggagucuaagauaggucggugguacucccguacuaugucaaaaaccgaacgcauggggaugggccucuaugucaaguacgacggagaucccugggcagacagugaugcucuuguguucagcggcgugauggucuccaugaaggagccggggugguacucuuuuggauucgaaaucaaagacaagaaaugcgauguuccuuguauugguaucgagauggugcacgacggcgggaaggaaacauggcauagcgccgcuacugccauauauugccugaugggaucaggccaguugcuaugggauaccguaacagguguggacauggcacuguga

SEQ ID NO: 152157 - RNA, 1401 nt, Artificial Sequence; identical to SEQ ID NO: 150972
  derived and/or modified sequence opt3 from neuraminidase__InfluenzaB__AHL93624

SEQ ID NO: 152158 - RNA, 1401 nt, Artificial Sequence; identical to SEQ ID NO: 152156
  derived and/or modified sequence opt3 from neuraminidase__InfluenzaB__AHL93635

SEQ ID NO: 152159 - RNA, 1401 nt, Artificial Sequence; identical to SEQ ID NO: 152156
  derived and/or modified sequence opt3 from neuraminidase__InfluenzaB__AHL93646

SEQ ID NO: 152160 - RNA, 1401 nt, Artificial Sequence; identical to SEQ ID NO: 150833
  derived and/or modified sequence opt3 from neuraminidase__InfluenzaB__AHL93657

SEQ ID NO: 152161 - RNA, 1401 nt, Artificial Sequence; identical to SEQ ID NO: 150972
  derived and/or modified sequence opt3 from neuraminidase__InfluenzaB__AHL93668

SEQ ID NO: 152162 - RNA, 1401 nt, Artificial Sequence
  derived and/or modified sequence opt3 from neuraminidase__InfluenzaB__AHL93679
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagaaggccuuacugaucucuccccaccgguucggcgaaacaaaaggaaauuccgcaccucuuauuauccgcgagccauuuauugccugcgggcccaacgaauguaagcauuucgcuuugacccacuacgcagcccagccuggcgguuauuacaaugggacgcgaggagaccguaacaaacugagacaucuaaucagcgugaagcucggcaagauaccaacugucgaaaauuccaucuuucacauggcugccuggucaggcagugcgugccaugaugggaaagaguggaccuauauuggaguggacgguccggauaacgacgcacugcuuaagguuaaauacggcgaggccuacacagauacuuaucacagcuacgcuaauaagauccugaggacccaggagucugccuguaacugcauugggggaaauuguuauuugaugaucacagacggcuccgcaucaggugugagcgaaugccgguuccucaaaauacgcgaggggagaauuaucaaggagauucugcccaccggaagggucaagcacacggaagaguguacuugcggcuuugcuaguaacaaaacaaucgaaugugccugccgggauaauucuuacaccgcgaagcgcccuuucgugaaauuaaacguagagacugacacagccgaaauccgacugaugugcaccgauacguaucucgacaccccaagacccgaugacggcuccauuacagggccuugugagagcaauggagacaaggguucgggcgggauaaaaggaggcuuuguucaucaaaggauggagucuaagaucggucggugguacucccguacuaugucaaaaaccgaacgcauggggaugggccuuuaugugaaguacgauggagacccaugggcagauagugacgcucuggccuucagcggcgucaugguguccaugaaggagcccgggugguacucuuuuggauucgaaauuaaagauaagaaaugcgacgugccguguaucgguauagagaugguccacgauggcgggaaggaaacauggcauagcgcugccacugcaauuuauugcuugaugggaucaggccagcuacugugggacaccguuacagguguggauauggcccucuga

SEQ ID NO: 152163 - RNA, 1401 nt, Artificial Sequence; identical to SEQ ID NO: 152156
  derived and/or modified sequence opt3 from neuraminidase__InfluenzaB__AHL93690

SEQ ID NO: 152164 - RNA, 1401 nt, Artificial Sequence; identical to SEQ ID NO: 152156
  derived and/or modified sequence opt3 from neuraminidase__InfluenzaB__AHL93701

SEQ ID NO: 152165 - RNA, 1401 nt, Artificial Sequence; identical to SEQ ID NO: 152156
  derived and/or modified sequence opt3 from neuraminidase__InfluenzaB__AHL93712

SEQ ID NO: 152166 - RNA, 1401 nt, Artificial Sequence
  derived and/or modified sequence opt3 from neuraminidase__InfluenzaB__AHL93723
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccaccacagggccaugugagagcaacggagacaaagguucgggcgggauaaagggaggcuucguacaccagaggauggcaucuaaaaucggucggugguacucccguacuaugucaaagaccgagcgcaaagggaugggccuguauguuaaguacgacggagaucccuggacagacagugaugcucucgccuuuagaggcgugauggucagcaugaaggaaccggggugguacuccuucggauucgagauuaaagacaagaaaugcgaugugccuuguaucgguauagaaauggugcaugacggcgggaaggagacuuggcacucugcugccaccgcaauuuauugccuuaugggaagcggccaacuguugugggauacagucaccgguguugacauggcccuauga

SEQ ID NO: 152167 - RNA, 1401 nt, Artificial Sequence; identical to SEQ ID NO: 150972
  derived and/or modified sequence opt3 from neuraminidase__InfluenzaB__AHL93734

SEQ ID NO: 152168 - RNA, 1401 nt, Artificial Sequence
  derived and/or modified sequence opt3 from neuraminidase__InfluenzaB__AHL93745
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauguucuuaggacucaggagucugccuguaacugcauugggggaaauuguuaucugaugaucaccgauggcuccgcaucaggugugagcgaaugccgguucuugaagauacgcgaggggagaauuaucaaagagauuuuuccuacaggaagggucaagcauaccgaagaguguacgugcggcuucgcuaguaacaagacuaucgaaugugccugccgggacaauucuuacacagcgaaacgcccauuugugaagcucaacguagagaccgauacugccgaaauccgacugaugugcacagacaccuauuuagauacgcccagaccugacgauggcuccauuaccgggccaugugagagcaacggagacaaagguucgggcgggauaaagggaggcuucguucaccagaggauggcaucuaaaaucggucggugguacucccguacaaugucaaagacugagcgcaaagggaugggccuguaugugaaguacgacggagaucccuggaccgacagugaugcucucgccuuuagaggcgucauggugagcaugaaggaaccggggugguacuccuucggauucgagauuaaagacaagaaaugcgaugugccuuguaucgguauagaaaugguccaugacggcgggaaggagacauggcacucugcugccacugcaauuuauugccuuaugggaagcggccaacuguugugggauaccguuacagguguggacauggcccuauga

SEQ ID NO: 152169 - RNA, 1401 nt, Artificial Sequence; identical to SEQ ID NO: 151135
  derived and/or modified sequence opt3 from neuraminidase__InfluenzaB__AHL93756

SEQ ID NO: 152170 - RNA, 1401 nt, Artificial Sequence; identical to SEQ ID NO: 152156
  derived and/or modified sequence opt3 from neuraminidase__InfluenzaB__AHL93767

SEQ ID NO: 152171 - RNA, 1401 nt, Artificial Sequence
  derived and/or modified sequence opt3 from neuraminidase__InfluenzaB__AHL93778
augcugcccagcaccauccagacacucauucuuuuccugacuuccggcgggguguuguuaucucuguacgucucagcccuacucaguuaucugcuuuacagcgacauacuguugaaguuuuccccuacggagaucaccgcuccaacaaugucucucgauugcgcaaacgccucgaauguucaagcggugaacagaucagcuacuaaaggaguaaccuuccugcugccggaacccgaguggacauauccuaggcucagcuguccagguaguauuuuucagaaggccuuacugaucucuccccaccgguucggcgaaaccaaaggaaauuccgcaccucuuauuauccgcgagccauuuauagccugcgggcccaacgaauguaagcauuucgcuuugacucacuacgcagcccagccuggcgguuauuacaaugggacacgaggagaccguaacaaacugagacaucuaaucagcgugaagcucggcaagauuccaaccgucgaaaauuccaucuuucacauggcugccuggucaggcagugcgugccaugaugggaaagaguggacguauauuggaguggacgguccggauaacgacgcacugcuuaagguuaaauacggcgaggccuacacugauaccuaucacagcuacgcuaauaagauccugaggacacaggagucugccuguaacugcauagggggaaauuguuauuugaugauuacugacggcuccgcaucaggugugagcgaaugccgguuccucaaaauccgcgaggggagaauuaucaaggagaucuuucccaccggaagggucaagcacacagaagaguguaccugcggcuucgcuaguaacaaaacgauugaaugugccugccgggauaauucuuacacugcgaagcgcccuuuugugaaacugaacguagagacagacaccgccgaaauacgauuaaugugcacugauacauaucuggacaccccaagacccgaugacggcuccaucacggggccuugugagagcaauggagacaaggguucgggcgggauuaaaggaggcuucguucaucaaaggauggagucuaagaucggucggugguacucccguaccaugucaaaaacagaacgcauggggaugggccucuaugugaaguacgauggagacccaugggcagauagugacgcucuugccuuuagcggcgucaugguguccaugaaggagcccgggugguacucuuucggauucgaaauaaaagauaagaaaugcgacgugccguguauugguaucgagaugguccacgauggcgggaaggaaacuuggcauagcgcugccaccgcaaucuauugccugaugggaucaggccaguugcuaugggacacaguuacugguguggauauggcccuguga

SEQ ID NO: 152172 - RNA, 1401 nt, Artificial Sequence
  derived and/or modified sequence opt3 from neuraminidase__InfluenzaB__AHL93789
augcugcccagcaccauccagacacucacucuuuuccugacguccggcgggguguuguuaucucuguacgucucagccagucuaagcuaucuccuguacuccgacauucuucugaaguuuucuccuaccggaauaacagcuccaacuaugccguuggauugcgcaaacgccucgaauguucaagcggugaacagaucagcuaccaaagguguaacacuccugcugcccgagccugaauggaccuauccaaggcucagcugucccggcaguacuuuccagaaggccuuacugaucuccccucaccgguuuggggagacaaaaggaaauucugcaccacuuauuauccgcgaacccuucauugccugcggcccuaacgaguguaagcauuuugcuuugacccacuacgcagcccagccagguggguauuacaauggaacgcgaggcgaccguaacaaacugagacaucuaaucagcgugaagcucggcaagauaccgacugucgaaaauuccaucuuccacauggcugccuggucagggagugcgugccaugauggaaaagaguggaccuauauugguguggacggccccgauaacaaugcacugcuuaagguuaaauacggggaggccuacacagacacuuaucacagcuacgcuaacaagauccugaggacccaggaaucugccuguaauugcauuggaggcaacuguuauuugauggugacagaugguuccgcaucaggggucagcgagugccgguuucucaaaauccgcgaaggaagaauaauuaaggagaucuucccuaccggcagggugaagcacacggaggaauguacuugcggcuuugcuaguaauaaaacaauugagugugccugccgggacaacucuuacaccgcgaagcgcccauucguaaaacugaauguugaaacugauacagccgagauccgauuaaugugcaccgacacguaucuggauacccccagaccugacgauggguccaucacaggaccaugugaaagcaacggugacaagggcucugggggaauuaaaggcgguuuugugcaucaaaggauggagucgaagauagggcggugguacucccguacuaugucaaaaaccgagcgcaugggcaugggacucuaugucaaguacgacggcgaucccugggcagacagugaugcucuuguguucagcggggugauggucuccaugaaggaaccgggaugguacucuuuugguuucgagaucaaagacaagaaaugcgauguuccuuguauuggcaucgaaauggugcacgacgggggaaaggagacauggcauagcgccgcuacugccauauauugccugaugggcucaggucaguugcuaugggauaccguaacagggguggacauggcacuguga

SEQ ID NO: 152173 - RNA, 1401 nt, Artificial Sequence; identical to SEQ ID NO: 150972
  derived and/or modified sequence opt3 from neuraminidase__InfluenzaB__AHL93800

SEQ ID NO: 152174 - RNA, 1401 nt, Artificial Sequence; identical to SEQ ID NO: 150972
  derived and/or modified sequence opt3 from neuraminidase__InfluenzaB__AHL93811

SEQ ID NO: 152175 - RNA, 1401 nt, Artificial Sequence; identical to SEQ ID NO: 151508
  derived and/or modified sequence opt3 from neuraminidase__InfluenzaB__AHL93822

SEQ ID NO: 152176 - RNA, 1401 nt, Artificial Sequence; identical to SEQ ID NO: 150972
  derived and/or modified sequence opt3 from neuraminidase__InfluenzaB__AHL93833

SEQ ID NO: 152177 - RNA, 1401 nt, Artificial Sequence
  derived and/or modified sequence opt3 from neuraminidase__InfluenzaB__AHL93844
augcugcccagcaccauccagacacucacucuuuuccugacguccggcgggguguuguuaucucuguacgucucagccagucuaagcuaucuccuguacuccgggauucuucugaaguuuucuccuaccgagauaacagcuccaacuaugccguuggacugcgcaaacgccucgaauguucaagcggugaacagaucagcuaccaaagaaguaacacuccugcugcccgagccugaauggaccuauccaaggcucagcugucccgguaguacuuuccagaaggccuuacugaucuccccucaccgguuuggcgagacaaaaggaaauucugcaccacuuauuauccgcgaacccuucauugccugcggaccuaacgaguguaagcauuuugcuuugacccacuacgcagcccagccaggcgguuauuacaaugggacgcgaggagaucguaacaaacugagacaucuaaucagcgugaagcucggcaagauaccgacugucgaaaauuccaucuuccacauggcugccuggucaggcagugcgugccaugacgggaaagaguggaccuauauuggaguggauggucccgacgauaacgcacugcuuaagguuaaauacggcgaggccuacacagacacuuaucacagcuacgcucacaagauccugaggacccaggaaucugccuguaauugcauugggggaaacuguuauuugaugaucacagauggcuccgcaucaggugugagcgagugccgguuucucaaaauacgcgaggggagaauuaucaaggaaauuuucccuaccggaagggucaagcauacggaggaauguacuugcggcuuugcuaguaauaaaacaaucgagugugccugccgggacaacucuuacaccgcgaagcgcccauucgugaaacugaauguagaaacugauacagccgagauccgauuaaugugcaccgacacguaucuggauacccccagaccuaacgacggcuccauuacagggccaugugagagcaauggagauaaggguucgggcgggauaaaaggaggcuuuguucaccaaaggauggaaucuaagaucggucggugguacucccguacuaugucaaaaaccgagcgcauggggaugggccucuaugugaaguacgacggagaccccugggcagauagugacgcucuugccuucagcggcgucaugguguccaugaaggaaccggggugguacucuuuuggauucgagauuaaagauaagaaaugcgacgugccuuguaucgguauagaaaugguccaugauggcgggaaggagacauggcacagcgcugccacugcaauuuauugccugaugggaucaggccaguugcuaugggacaccguuacagguguggauauggcccuguga

SEQ ID NO: 152178 - RNA, 1401 nt, Artificial Sequence; identical to SEQ ID NO: 150972
  derived and/or modified sequence opt3 from neuraminidase__InfluenzaB__AHL93855

SEQ ID NO: 152179 - RNA, 1401 nt, Artificial Sequence; identical to SEQ ID NO: 150972
  derived and/or modified sequence opt3 from neuraminidase__InfluenzaB__AHL93866

SEQ ID NO: 152180 - RNA, 1401 nt, Artificial Sequence; identical to SEQ ID NO: 150972
  derived and/or modified sequence opt3 from neuraminidase__InfluenzaB__AHL93877

SEQ ID NO: 152181 - RNA, 1401 nt, Artificial Sequence; identical to SEQ ID NO: 150972
  derived and/or modified sequence opt3 from neuraminidase__InfluenzaB__AHL93888

SEQ ID NO: 152182 - RNA, 1401 nt, Artificial Sequence
  derived and/or modified sequence opt3 from neuraminidase__InfluenzaB__AHL93899
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgaaccuaacgaguguaagcacuucgcucuuacacauuacgcagcccagccagggggcuauuacaaugguacccgaggggaccguaacaaauugagacaccugaucagcgugaagcuaggaaagauaccgacggucgaaaauuccaucuuucauauggcugccuggucaggcagugcgugccacgauggcaaagaguggacuuauauugggguggacggacccgauaacaaugcacuccugaagaucaaauacggugaggccuacaccgacacauaucacagcuacgcuaacaauauucuuaggacucaggaaucugccuguaacugcaucggcgggaauuguuaucugaugauaaccgauggauccgcaucaggcguuagcgagugccgguucuugaagauucgcgaggguagaaucauuaaagaaaucuuuccuacagggagggugaagcauaccgaggaauguacgugcggauucgcuaguaacaagacuaucgagugugccugccgggacaauucuuacacagcgaaacgcccauuugucaagcucaacguggaaaccgauacugccgagauucgacugaugugcacagacaccuauuuagauacgcccagaccugacgauggcuccaccacaggcccaugugagagcaacggggacaaaggaucggguggcauaaaagggggauucguacaccagaggauggcaucuaagaucggccggugguacucccguacuaugucaaagaccgaacgcaaagguauggggcuguauguuaaguacgacggcgaucccuggacagacagugaugcucucgccuuuagaggagugauggucagcaugaaggagccgggcugguacuccuucggguucgaaauuaaagacaagaaaugcgaugugccuuguaucggaauagagauggugcaugacgguggcaaggaaacuuggcacucugcugccaccgcaauuuauugccuuauggggagcggacaacuguugugggauacagucaccggcguugacauggcccuauga

SEQ ID NO: 152183 - RNA, 1401 nt, Artificial Sequence
  derived and/or modified sequence opt3 from neuraminidase__InfluenzaB__AHL93910
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaauguacaugccgggacaauucuuacaccgccaaacgcccauuugucaagcucaacguggagacugauacagcggaaauucgacugaugugcaccgacacguauuuagauacccccagaccugacgauggcgggauaacaggaccaugugaguccaacggugacaaaggcagcgggggaaucaagggcgguuucguacaccagaggauggccucgaaaauugggcggugguacucucguacuauguccaagaccgagcgcaaaggcaugggacuguauguuaaguacgacggcgaucccuggacagacucagaugcacucgcuuuuagaggggugauggucaguaugaaggaaccgggaugguacagcuucgguuucgagaucaaagacaagaaaugcgaugugccuuguauaggcauugaaauggugcaugacgggggaaaggagacuuggcacuccgccgcuaccgccaucuauugccuuaugggcucuggucaacuguugugggauacagucaccgggguugacauggcacuauga

SEQ ID NO: 152184 - RNA, 1401 nt, Artificial Sequence; identical to SEQ ID NO: 150972
  derived and/or modified sequence opt3 from neuraminidase__InfluenzaB__AHL93921

SEQ ID NO: 152185 - RNA, 1401 nt, Artificial Sequence
  derived and/or modified sequence opt3 from neuraminidase__InfluenzaB__AHL93932
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugauggugacagauggcuccgcaucaggugucagcgaaugccgguuucucaaaauccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaaauccgauuaaugugcaccgacacguaucuggauacccccagaccugacgauggcuccaucacagggccaugugagagcaacggagacaaggguucgggcgggauuaaaggaggcuuugugcaucaaaggauggagucuaagauaggucggugguacucccguacuaugucaaaaaccgaacgcauggggauggagcucuaugucaaguacgacggcgaucccugggcagacagugaugcucuugccuucagcggagugaugguguccaugaaggaaccgggcugguacucuuuuggguucgagaucaaagacaagaaaugcgaugucccuuguauuggaaucgaaaugguucacgacgguggcaaggagacauggcauagcgcugccacugcaauauauugccugauggggucaggacaguugcuaugggauaccgugacaggcguagacauggcccuguga

SEQ ID NO: 152186 - RNA, 1401 nt, Artificial Sequence; identical to SEQ ID NO: 151135
  derived and/or modified sequence opt3 from neuraminidase__InfluenzaB__AHL93943

SEQ ID NO: 152187 - RNA, 1401 nt, Artificial Sequence; identical to SEQ ID NO: 150972
  derived and/or modified sequence opt3 from neuraminidase__InfluenzaB__AHL93954

SEQ ID NO: 152188 - RNA, 1401 nt, Artificial Sequence
  derived and/or modified sequence opt3 from neuraminidase__InfluenzaB__AHL93965
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacuguucagccacuaaaggaguaacccuccugcugcccgaaccugaguggacauauccaagacucagcugccccgguaguaccuuccagaaggcauuacugaucuccccucacagguuuggcgaaacuaaaggaaauucugccccacuuauuauccgggagcccuucauugcuugugggccuaacgaaugcaagcauuuugcauugacacacuacgccgcucagccaggcgguuauuacaaugggacccgcggagaccgaaacaaacugcgucaucuaaucagcgugaagcucggcaagauaccgacggucgaaaauuccaucuuccacauggccgcguggucaggcagugcaugucaugaugggaaagaguggacuuauauuggaguggacggucccgauaacaaugcccugcuuaagguuaaauacggcgaggcuuacaccgacacauaucacagcuacgccaacaagauccugagaacucaggagucugcaugcaauuguauugggggaaacugcuauuugaugaucaccgauggcuccgcuucaggugugagcgaauguagguuucucaaaauacgggaggggcgcauuaucaaggagauuuucccuacaggaagagucaagcacaccgaagagugcacguguggcuuugccaguaauaaaacuaucgaaugcgcgugcagggacaacucuuacacagccaagcggccauucgugaaacugaauguagagaccgauacugcagaaauccgcuuaauguguacagacaccuaucuggauacgccccgaccuaacgacggcuccauuaccgggccaugcgagagcgauggagacaaggguaacggcgggauaaaaggaggcuuuguucaucaaagaauggagucgaagaucgguaggugguacucucggacaauguccaaaacugaacguauggggaugggccucuaugugaaguacgacggagaucccugggcugacucagaugcccuugcuuucaguggcgucauggugagcaugaaggagccggggugguacuccuuuggauucgaaauuaaagacaagaaaugugaugugccuugcaucgguauagagaugguccacgacggcgggaaggaaaccuggcauucugccgcaacagccauuuauugucugaugggaagcggccaguugcuaugggauacuguuaccgguguggacauggcucuguga

SEQ ID NO: 152189 - RNA, 1401 nt, Artificial Sequence; identical to SEQ ID NO: 150891
  derived and/or modified sequence opt3 from neuraminidase__InfluenzaB__AHL93976

SEQ ID NO: 152190 - RNA, 1401 nt, Artificial Sequence; identical to SEQ ID NO: 152162
  derived and/or modified sequence opt3 from neuraminidase__InfluenzaB__AHL93987

SEQ ID NO: 152191 - RNA, 1401 nt, Artificial Sequence
  derived and/or modified sequence opt3 from neuraminidase__InfluenzaB__AHL93998
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaucaaaggaaauuccgccccucuuauuauccgcgagccauucauagcuugcgggcccaccgaauguaagcauuuugcauugacucacuacgccgcucagccuggcgguuauuacaacgggacacgagaggaccguaauaaacugagacaucuaaucagcgugaagcucggaaagauuccaaccgucgagaacuccaucuuccacauggccgcguggucaggcagugcaugccaugauggcaaagaauggacguauauugggguggacggaccggauagcaaugcccugcuuaagaucaaauacggugaggcuuacacugacaccuaucacucuuacgccaagaacauacugaggacacaagaauccgcauguaauugcauuggcggggauuguuauuugaugaucacugacggacccgcuucaggcguuagcgagugccgguuucucaaaauucgcgaggguagaaucaucaaggaaauuuucccuaccgggagggugaagcacacagaggaauguaccugcggauuugccaguaacaaaacgauagagugugcgugccgggauaaucgcuacacugccaagcgaccauucgucaaacugaacguggaaacagacaccgcagagaucagauuaaugugcacugagacauaucuggauacccccaggccuaaugacggcucuauuacgggcccaugugaauccgauggggacaagggaagcgguggcaucaaagggggauuuguacaucagcggauggcuucgaagauaggccguugguacucucgcaccauguccaaaacaaagagaauggguauggggcucuauguuaaguacgacggcgaucccuggacugacucagaggcccuugcucugaguggagugauggucagcauggaggaaccgggcugguacuccuucggguuugaaauuaaagauaagaaaugcgacgugccuuguaucggaaucgagauggugcacgaugguggcaagaccacauggcauucugccgcaacugccauuuauugcuugauggggagcggacagcuacugugggacaccgucacaggcguugauauggcucucuga

SEQ ID NO: 152192 - RNA, 1401 nt, Artificial Sequence
  derived and/or modified sequence opt3 from neuraminidase__InfluenzaB__AHL94009
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccuaaguggacauauccaaggcugagcugucccgguaguaccuuucaaaaagcccucuuaaucuccccucaucgguucggcgagacuaagggaaauucugcaccacugauuauccgcgaacccuuuauugccugcgggccuaacgagugucgacacuucgcucuuacacauuacgcagcccagccaggcgguuauuacaaugggacccguggagacagaaacaaauugaggcaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuucggacucaggaaucugccuguaacugcaucgggggaaauuguuaucugaugauaaccgauggcuccgcaucagguguuagcgagugccgcuucuugaagauuagagaagggaggaucauuaaagagaucuuuccuacaggacgggugaagcauaccgaggaauguacgugcggcuucgcuaguaacaagacuaucgagugugccugccgcgacaauucuuacacagcgaaacgaccauuugucaagcucaacguggaaaccgauacugccgagauuagacugaugugcacagacaccuauuuagauacgcccaggccugacgauggcuccauaaccgggccaugugaaagcaacggagacaaagguucgggcgggaucaagggaggcuucguacaccagcggauggcaucuaaaauuggucguugguacucccgcacaaugucaaagacugagagaaaagggaugggccuguauguuaaguacgacggagaucccuggaccgacagugaugcucucgccuuuaggggcgugauggucagcaugaaggagccggggugguacuccuucggauucgaaaucaaagacaagaaaugcgaugugccuuguauagguauugagauggugcaugacggcgggaaggaaacauggcacucugcugccacugcaaucuauugccuuaugggaagcggccaacuguugugggauaccgucacagguguugacauggcccuauga

SEQ ID NO: 152193 - RNA, 1401 nt, Artificial Sequence; identical to SEQ ID NO: 150972
  derived and/or modified sequence opt3 from neuraminidase__InfluenzaB__AHL94020

SEQ ID NO: 152194 - RNA, 1401 nt, Artificial Sequence; identical to SEQ ID NO: 150972
  derived and/or modified sequence opt3 from neuraminidase__InfluenzaB__AHL94031

SEQ ID NO: 152195 - RNA, 1401 nt, Artificial Sequence; identical to SEQ ID NO: 151135
  derived and/or modified sequence opt3 from neuraminidase__InfluenzaB__AHL94042

SEQ ID NO: 152196 - RNA, 1401 nt, Artificial Sequence
  derived and/or modified sequence opt3 from neuraminidase__InfluenzaB__AHL94053
augcugcccagcaccauccagacacucacucuuuuccugacguccggcgggguguuguuaucucuguaccuaucagcccuccugaguuaucuucuguacagcgacauuuugcucaaguuuuccccuaccgagauaacagcuccaacuaugucucuggauugcgcaaacgccucgaauguccaagcgguuaacagaucagcuaccaaaggagugacauuccugcucccggaacccgaguggaccuauccuagguuaagcuguccagguaguacuuuucagcgggcccugcuuaucucuccccaccgcuucggcgaaacaaagggaaauuccgcaccuuugauuauccgagagccauuuauugccugcgggcccaacgaauguaaacauuucgcucugacccacuacgcagcccagccuggcgguuauuacaaugggacgcguggagacagaaacaagcuaaggcaucucaucagcguaaaacugggcaagauaccaacuguggaaaauuccaucuuucacauggcugccuggucaggcagugcgugccaugaugggaaggaguggaccuauauuggagucgacgguccggauaacgacgcacuucugaaagugaaguacggcgaggccuacacagauacuuaucacagcuacgcuaauaaaaucuugcggacccaggagucugccuguaacugcauugggggaaauuguuaucucaugaucacagacggcuccgcaucagguguuagcgaaugccgcuuccugaagauaagagaggggaggauuaucaaagagauuuuucccaccggacgggugaagcacacggaagaguguacuugcggcuucgcuaguaacaagacaaucgaaugugccugccgcgauaauucuuacaccgcgaaacgaccuuuugucaaguuaaacguggagacugacacagccgaaaucagacugaugugcaccgauacguaucucgacaccccaaggcccgaugacggcuccauuacagggccuugugagagcaauggagacaaagguucgggcgggauaaagggaggcuucguacaucaacggauggagucuaaaaucggucguugguacucccgcacuaugucaaagaccgaaagaauggggaugggccuuuauguuaaauacgauggagacccaugggcagauagugacgcucuggccuuuagcggcgugauggucuccaugaaggagcccgggugguacucuuucggauucgaaauuaaggauaaaaagugcgacgugccguguaucgguauagagauggugcacgauggcgggaaagaaacauggcauagcgcugccacugcaauuuauugcuugaugggaucaggccagcuacugugggacaccgucacagguguugauauggcccucuga

SEQ ID NO: 152197 - RNA, 1401 nt, Artificial Sequence; identical to SEQ ID NO: 150972
  derived and/or modified sequence opt3 from neuraminidase__InfluenzaB__AHL94064

SEQ ID NO: 152198 - RNA, 1401 nt, Artificial Sequence; identical to SEQ ID NO: 150972
  derived and/or modified sequence opt3 from neuraminidase__InfluenzaB__AHL94075

SEQ ID NO: 152199 - RNA, 1401 nt, Artificial Sequence
  derived and/or modified sequence opt3 from neuraminidase__InfluenzaB__AHL94086
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccuuccuccugccggaacccgaguggacauauccucggcugagcuguccagguaguaccuuucagaaggcccucuuaauuucuccccaccgcuucggcgaaacuaaaggaaauuccgcaccucugaucauucgagagccauuuguggccugcgggcccaaggaauguaaacauuucgcucuuacacacuacgcagcccagccuggcgguuauuacaacgggacccgugaggacagaaauaaguugaggcaucugaucagcgucaagcuaggaaaaauaccaacgguggagaacuccaucuuucacauggcugccuggucaggcagugcgugccaugauggccgggaauggacuuauauugggguugacggaccggauagcaaugcacuccugaagaucaaauacggugaggccuacaccgacacauaucacucuuacgcuaagaacauucuucgcacucaggaauccgccuguaauugcaucggcggggauuguuaucugaugauaaccgacggacccgcaucaggcauuagcgagugcagauucuugaaaaucagggagggucggauuaucaaggaaaucuuuccuacagggcgcgugaagcacaccgaggaauguacgugcggauucgcuaguaacaaaacuauugagugugccugccgagauaauucuuacacagcgaagagaccauuugucaaacucaacguggaaaccgacacugccgagauaaggcugaugugcacagagaccuauuuagauacgccccggccuaaugacggcuccaucaccggcccaugugaaagcaacggggauaagggaucggguggcauuaaagggggauucguacaucaacguauggcaucuaagaucggccgcugguacuccagaacaaugucaaaaacuaagaggauggguauggggcuguauguuaaguacgacggcgaccccuggaccgauagugaggcucucgcccuuagcggagugauggucuccauggaggaaccgggcugguacucuuuuggguucgaaauaaaagacaagaaaugcgaugugccuuguauuggaaucgagauggugcacgacgguggcaagacaacuuggcauagcgcugccaccgcaaucuauugccugauggggucaggacaguugcuaugggauacagucaccggcguuaauaugacucuguga

SEQ ID NO: 152200 - RNA, 1401 nt, Artificial Sequence; identical to SEQ ID NO: 151135
  derived and/or modified sequence opt3 from neuraminidase__InfluenzaB__AHL94095

SEQ ID NO: 152201 - RNA, 1401 nt, Artificial Sequence; identical to SEQ ID NO: 150972
  derived and/or modified sequence opt3 from neuraminidase__InfluenzaB__AHL94106

SEQ ID NO: 152202 - RNA, 1401 nt, Artificial Sequence
  derived and/or modified sequence opt3 from neuraminidase__InfluenzaB__AHL94117
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcaaagggaugggccugcauguuaaguaugacggagaucccuggaccgacagugaugcucucgccuuuagaggcgugauggucagcaugaaggaaccggggugguacuccuucggauucgagaucaaagacaagaaaugcgaugugccuuguauagguauugaaauggugcacgacggcgggaaggagacauggcacucugcugccacugcaaucuacugccuuaugggaagcggccaacuguugugggauaccgucacagguguuaauauggcccuauga

SEQ ID NO: 152203 - RNA, 1401 nt, Artificial Sequence; identical to SEQ ID NO: 150972
  derived and/or modified sequence opt3 from neuraminidase__InfluenzaB__AHL94128

SEQ ID NO: 152204 - RNA, 1401 nt, Artificial Sequence
  derived and/or modified sequence opt3 from neuraminidase__InfluenzaB__AHL94139
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugccggaacccgaguggaccuauccuaggcucagcuguccagguaguacuuuucagcgggccuuacugaucucuccccaccgcuucggcgaaacaaagggaaauuccgcaccucuuauuauccgagagccauuuauugccugcgggcccaacgaauguaaacauuucgcuuugacccacuacgcagcccagccuggcgguuauuacaaugggacgcguggagacagaaacaagcugaggcaucuaaucagcgugaaacucggcaagauaccaacugucgaaaauuccaucuuucacauggcugccuggucaggcagugcgugccaugaugggaaggaguggaccuauauuggaguggacgguccggauaacgacgcacugcuuaaaguuaaguacggcgaggccuacacagauacuuaucacagcuacgcuaauaaaauccugcggacccaggagucugccuguaacugcauugggggaaauuguuauuugaugaucacagacggcuccgcaucaggugugagcgaaugccgcuuccucaagauaagagaggggaggauuaucaaagagauuuuucccaccggacgggucaagcacacggaagaguguacuugcggcuucgcuaguaacaagacaaucgaaugugccugccgcgauaauucuuacaccgcgaaacgaccuuuugugaagcugaacguagagacugacacagccgaaaucaaauuaaugugcaccgauacguaucuggacaccccaagacccgaugacggcuccauuacagggccuugugagagcaauggagacaaggguucgggcgggauaaaaggaggcuucguucaucaaaggauggagucuaagaucggucggugguacucccguacuaugucaaaaaccgaacgcauggggaugggccucuaugugaaguacgauggagacccaugggcagauagugacgcucuugccuuuagcggcgucaugguguccaugaaggagcccgggugguacucuuucggauucgaaauuaaagauaagaaaugcgacgugccguguaucgguauagagaugguccacgauggcgggaaggaaacauggcauagcgcugccacugcaauuuauugccugaugggaucaggccaguugcuaugggacaccguuacagguguggauauggcccuguga

SEQ ID NO: 152205 - RNA, 1401 nt, Artificial Sequence; identical to SEQ ID NO: 152162
  derived and/or modified sequence opt3 from neuraminidase__InfluenzaB__AHL94150

SEQ ID NO: 152206 - RNA, 1401 nt, Artificial Sequence
  derived and/or modified sequence opt3 from neuraminidase__InfluenzaB__AHL94161
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccaaaauucgacugaugugcacagacaccuauuuagauacgcccagaccugacgauggcuccauaaccgggccaugugaaagcaacggagacaaggguucgggcgggaucaaaggaggcuucguacaccagaggauggcaucuaagauuggucggugguacucccguacaaugucaaaaacugagcgcaaggggaugggccuguauguuaaguacgacggagaucccuggaccgacagugaugcucucgccuuuagaggcgugauggucagcaugaaagagccggggugguacuccuucggauucgaaaucaaggacaaaaagugcgaugugccuuguauagguauugagauggugcaugacggcgggaaagaaacauggcacucugcugccacugcaaucuauugccuuaugggaagcggccaacuguugugggauaccgucacagguguugacauggcccuauga

SEQ ID NO: 152207 - RNA, 1401 nt, Artificial Sequence; identical to SEQ ID NO: 152162
  derived and/or modified sequence opt3 from neuraminidase__InfluenzaB__AHL94183

SEQ ID NO: 152208 - RNA, 1404 nt, Artificial Sequence
  derived and/or modified sequence opt3 from neuraminidase__InfluenzaB__AHL94194
augcugcccagcaccauccagacacucacucuuuuccugacguccggcgggguguuguuaucucuguacgucucagcccuacucaguuaucugcuuuacagcgacauucuguugaaguuuuccccuaccgagauaacagcuccaacuaugucucucgauugcgcaaacgccucgaauguucaagcggugaacagaucagcuaccaaaggaguaacauuccugcugcucccggaacccgaguggaccuauccuagguuaagcuguccagguaguacuuuucagcgggcccugcuuaucucuccccaccgcuucggcgaaacaaagggaaauuccgcaccuuugauuauccgagagccauuuauugccugcgggcccaacgaauguaaacauuucgcucugacccacuacgcagcccagccuggcgguuauuacaaugggacgcguggagacagaaacaagcuaaggcaucucaucagcgugaaacugggcaagauaccaacugucgaaaauuccaucuuucacauggcugccuggucaggcagugcgugccaugaugggaaggaguggaccuauauuggaguggacgguccggauaacgacgcacuucugaaaguuaaguacggcgaggccuacacagauacuuaucacagcuacgcuaauaaaaucuugcggacccaggagucugccuguaacugcauugggggaaauuguuaucucaugaucacagacggcuccgcaucaggugugagcgaaugccgcuuccugaagauaagagaggggaggauuaucaaagagauuuuucccaccggacgggucaagcacacggaagaguguacuugcggcuucgcuaguaacaagacaaucgaaugugccugccgcgauaauucuuacaccgcgaaacgaccuuuugugaaguuaaacguagagacugacacagccgaaaucagacugaugugcaccgauacguaucucgacaccccaaggcccgaugacggcuccauuacagggccuugugagagcaauggagacaaagguucgggcgggauaaagggaggcuucguucaucaacggauggagucuaaaaucggucguugguacucccgcacuaugucaaagaccgaaagaauggggaugggccuuuaugugaaauacgauggagacccaugggcagauagugacgcucuggccuuuagcggcgucaugguguccaugaaggagcccgggugguacucuuucggauucgaaauuaaggauaaaaagugcgacgugccguguaucgguauagagaugguccacgauggcgggaaagaaacauggcauagcgcugccacugcaauuuauugcuugaugggaucaggccagcuacugugggacaccguuacagguguggauauggcccucuga

SEQ ID NO: 152209 - RNA, 1401 nt, Artificial Sequence; identical to SEQ ID NO: 150972
  derived and/or modified sequence opt3 from neuraminidase__InfluenzaB__AHL94205

SEQ ID NO: 152210 - RNA, 1401 nt, Artificial Sequence; identical to SEQ ID NO: 151135
  derived and/or modified sequence opt3 from neuraminidase__InfluenzaB__AHL94214

SEQ ID NO: 152211 - RNA, 1401 nt, Artificial Sequence
  derived and/or modified sequence opt3 from neuraminidase__InfluenzaB__AHL94224
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgggggaaauuguuaucugaugauaaccgauggcuccgcaucagguguuagcgaaugccgguucuugaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcucaacguggagaccgauacugccgaaauucgacugaugugcacagacaccuauuuagauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcaaagggaugggccuguauguuaaguacgacggagaucccuggaucgacagugaugcucucgccuuuagaggcgugauggucagcaugaaggaaccggggugguacuccuucggauucgagauaaaagacaagaaaugcgaugugccuuguauugguaucgaaauggugcaugacggcgggaaggagaccuggcacucugcugccacagcaaucuauugccuuaugggaagcggccaacuguugugggauacugucaccgguguugacauggcccuauga

SEQ ID NO: 152212 - RNA, 1401 nt, Artificial Sequence; identical to SEQ ID NO: 150972
  derived and/or modified sequence opt3 from neuraminidase__InfluenzaB__AHL94235

SEQ ID NO: 152213 - RNA, 1401 nt, Artificial Sequence; identical to SEQ ID NO: 151135
  derived and/or modified sequence opt3 from neuraminidase__InfluenzaB__AHL94246

SEQ ID NO: 152214 - RNA, 1401 nt, Artificial Sequence; identical to SEQ ID NO: 151135
  derived and/or modified sequence opt3 from neuraminidase__InfluenzaB__AHL94257

SEQ ID NO: 152215 - RNA, 1401 nt, Artificial Sequence; identical to SEQ ID NO: 150833
  derived and/or modified sequence opt3 from neuraminidase__InfluenzaB__AHL94267

SEQ ID NO: 152216 - RNA, 1401 nt, Artificial Sequence; identical to SEQ ID NO: 150833
  derived and/or modified sequence opt3 from neuraminidase__InfluenzaB__AHL94278

SEQ ID NO: 152217 - RNA, 1401 nt, Artificial Sequence; identical to SEQ ID NO: 150833
  derived and/or modified sequence opt3 from neuraminidase__InfluenzaB__AHL94299

SEQ ID NO: 152218 - RNA, 1401 nt, Artificial Sequence
  derived and/or modified sequence opt3 from neuraminidase__InfluenzaB__AHL94310
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccccgcuccugcccgaaccugaguggacauauccacggcugagcugucccgguaguaccuuccagaaggcccucuuaauuuccccucaccgcuuuggcgaaacuaaaggaaauucugcaccacugaucauucgagagcccuucaucgccugcgggccuaaggaauguaaacauuuugcucuuacacacuacgcagcccagccaggcgguuauuacaacgggacccgugaggacagaaauaaguugaggcaucugauaagcgugaagcuaggaaaaaucccgacggucgagaacuccauuuuccacauggcugccuggucaggcagugcgugccaugauggccgggaauggacuuauaucgggguggacggacccgauagcaaugcacuccugaagauuaaauacggugaggccuacaccgacacauaucacucuuacgcuaagaacauccuucgcacucaggaauccgccuguaauugcauaggcggggauuguuaucugaugauuaccgacggaucagcaagcggcaucagugagugcagauuuuugaaaauuagggagggucggaucaucaaggaaauuuucccuacagggcgcguuaagcacaccgaggaauguacgugcggauuugcuucuaacaaaacuauagagugugccugccgagauaauuccuacacagcgaagagaccauucgugaaacucaacgucgaaaccgacacugccgagaucaggcugaugugcacagagaccuauuuagauacgccccggccuaaugacggcagcauugcaggcccaugugaaucgaacggggaugagggaucugguggcaucaaagggggauuugugcaucaacguauggcuuccaagauaggccgcugguacucaagaaccaugaguaagacaaaaaggauggguauggggcuguauguaaaguacgacggcgaccccuggacugauagcgaagcccucgcucuuuccggaguuauggugucuauggaggaaccgggcugguacagcuucggguuugagauuaaggacaaaaagugcgaugucccuuguaucggaaucgagauggugcacgacgguggcaaaaccacauggcauucagccgcaacugccauuuauugccugauggggaguggacaguugcuaugggauaccgugacaggcgucaauaugacccuguga

SEQ ID NO: 152219 - RNA, 1401 nt, Artificial Sequence; identical to SEQ ID NO: 152218
  derived and/or modified sequence opt3 from neuraminidase__InfluenzaB__AHL94321

SEQ ID NO: 152220 - RNA, 1401 nt, Artificial Sequence
  derived and/or modified sequence opt3 from neuraminidase__InfluenzaB__AHL94332
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccccgcuccugcccgaaccugaguggacauauccacggcugagcugucccgguaguaccuuccagaaggcccucuuaauuuccccucaccgcuuuggcgaaacuaaaggaaauucugcaccacugaucauucgagagcccuucaucgccugcgggccuaaggaauguaaacauuuugcucuuacacacuacgcagcccagccaggcgguuauuacaacgggacccgugaggacagaaauaaguugaggcaucugauaagcgugaagcuaggaaaaaucccgacggucgagaacuccauuuuccacauggcugccuggucaggcagugcgugccaugauggccgggaauggacuuauaucgggguggacggacccgauagcaaugcacuccugaagauuaaauacggugaggccuacaccgacacauaucacucuuacgcuaagaacauccuucgcacucaggaauccgccuguaauugcauaggcggggauuguuaucugaugauuaccgacggaccugcaucaggcaucagcgagugcagauuuuugaaaauuagggagggucggaucaucaaggaaauuuucccaacagggcgcguuaagcacaccgaggaauguacgugcggauuugcuaguaacaaaacuauagagugugccugccgagauaauucuuacacagcgaagagacccuucgugaaacucaacgucgaaaccgacacugccgagaucaggcugaugugcacagagaccuauuuagauacgccucggccaaaugacggcuccauuaccggccccugugaaagcaacggggaugagggaucggguggcaucaaagggggauuugugcaucaacguauggcaucuaagauaggccgcugguacuccagaacaaugucaaagacuaaaaggauggguauggggcuguauguaaaguacgacggcgacccguggaccgauagugaagcucucgcccuuagcggaguuaugguguccauggaggaaccuggcugguacucuuucggguuugagauuaaggacaaaaagugcgauguccccuguaucggaaucgagauggugcacgacgguggcaaaacaacuuggcauagcgcugccaccgcaauuuauugccugauggggucaggacaguugcuaugggauacagugaccggcgucaauaugacucuguga

SEQ ID NO: 152221 - RNA, 1401 nt, Artificial Sequence; identical to SEQ ID NO: 150833
  derived and/or modified sequence opt3 from neuraminidase__InfluenzaB__AHL94343

SEQ ID NO: 152222 - RNA, 1401 nt, Artificial Sequence
  derived and/or modified sequence opt3 from neuraminidase__InfluenzaB__AHL94354
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccucuaugugaaguacgacggagaucccugggcagacucagaugcucuugccuucaguggcgucauggugagcaugaaagaaccggggugguacuccuuuggauucgagauuaaggacaaaaagugcgaugugccuuguaucgguauagaaaugguccacgacggcgggaaagagacauggcauucugcugccacugcaauuuauugccugaugggaagcggccaguugcuaugggauaccguuacagguguggacauggcccuguga

SEQ ID NO: 152223 - RNA, 1401 nt, Artificial Sequence; identical to SEQ ID NO: 152222
  derived and/or modified sequence opt3 from neuraminidase__InfluenzaB__AHL94365

SEQ ID NO: 152224 - RNA, 1401 nt, Artificial Sequence
  derived and/or modified sequence opt3 from neuraminidase__InfluenzaB__AHL94387
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaccguucaagcggugaauagaucagcuacaaaaggaguaacccuccugcugcccgaaccugaguggacuuauccaaggcucagcugucccgguaguacauuccagaaggccuuacugaucuccccucaccgguuuggcgaaaccaaagggaacucugcaccacuuauuauccgcgagcccuucauugccugcggaccuaaugaauguaagcauuuugcuuugacgcacuacgcagcccagccaggcgguuauuacaacgggacucgaggagaccguaauaaacugagacaucuaaucagcgugaagcucggcaagauaccgaccgucgagaacuccaucuuccacauggcugccuggucaggcagugcgugccaugaugggaaagaguggacauaucugggaguggacggucccgauaauaacgcacuucugaagguuaaauacggcgaagccuacacugacaccuaucacagcuacgcuaauaagauuuugaggacacaggagucugccuguaacugcaucgggggaaauuguuaucucaugauuaccgauggcuccgcaucaggugugagcgaaugccgguuucugaaaauccgcgaggggagaauaauuaaggagaucuucccuacgggaagggucaagcacacugaagaguguacaugcggcuuugcuaguaacaaaaccauugaaugugccugccgggacaaucgcuacacugcgaagcgaccauucgugaaauuaaacguagagacagauaccgccgaaaucagacugaugugcacggacaccuaucucgauacacccaggccuaaugacggcucuaucacugggccaugugaguccgauggagacaaggguagcggcgggauuaaaggaggcuuuguucaucaacggaugaagucgaaaauaggucguugguacucucgcaccauguccaagacagagagaauggggaugggccuuuaugugaaguacgacggagaucccugggcagacucagaugcucuggccuucaguggcgucauggugagcaugaaagaaccggggugguacuccuuuggauucgagaucaaggacaaaaagugcgaugugccuuguauugguaucgaaaugguccacgacggcgggaaagagauauggcauucugcugccacugcaauuuauugcuugaugggaagcggccagcuacugugggauaccguuacagguguggacauggcccucuga

SEQ ID NO: 152225 - RNA, 1404 nt, Artificial Sequence
  derived and/or modified sequence opt3 from neuraminidase__InfluenzaB__AHL94398
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcuccccgaaccugaguggaccuauccaagguuaagcugucccgguaguacuuuccagaaggcccugcuuaucuccccucaccgguuuggcgaaacaaaaggaaauucugcaccauugauuauccgcgagcccuucauugccugcgggccuaacgaauguaagcauuuugcucugacccacuacgcagcccagccaggcgguuauuacaaugggacgcgaggagaccguaacaaacuaagacaucucaucagcgugaagcugggcaagauaccgacugucgaaaauuccaucuuccacauggcugccuggucaggcagugcgugccaugaugggaaagaguggaccuauauuggaguggacggucccgauaacaaugcacuucugaagguuaaauacggcgaggccuacacagacacuuaucacagcuacgcuaacaagaucuugaggacccaggagucugccuguaauugcauugggggaaacuguuaucucaugaucacagauggcuccgcaucaggugugagcgaaugccgguuucugaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaauuaaauguagagacugauacagccgaaaucagacugaugugcaccgacacguaucucgauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccuuuaugugaaguacgacggagaucccugggcagacucagaugcucuggccuucaguggcgucauggugagcaugaaagaaccggggugguacuccuuuggauucgagauuaaggacaaaaagugcgaugugccuuguaucgguauagaaaugguccacgacggcgggaaagagacauggcauucugcugccacugcaauuuauugcuugaugggaagcggccagcuacugugggauaccguuacagguguggacauggcccucuga

SEQ ID NO: 152226 - RNA, 1401 nt, Artificial Sequence; identical to SEQ ID NO: 152222
  derived and/or modified sequence opt3 from neuraminidase__InfluenzaB__AHL94409

SEQ ID NO: 152227 - RNA, 1401 nt, Artificial Sequence
  derived and/or modified sequence opt3 from neuraminidase__InfluenzaB__AHL94431
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcugccaaaggaguaacucucauucugccggaacccgaguggaccuauccuagacugagcuguccagguaguacauuccagaaggcacucuuaaucucuccccauagguuuggcgaaauuaaaggaaauuccgccccucugaucauacgggagccauucaucgcuugcgggcccaccgaauguaagcacuuugcacuuacucauuacgccgcucagccuggcgguuauuacaacgggacacgcgaggaccgaaauaaauugcgucaccugauuagcgugaagcuaggaaagaucccaaccgucgagaacuccauuuuccauauggccgcguggucaggcagugcaugccacgauggcaaagaauggacguauaucgggguggacggaccggauagcaaugcccuccugaagauaaaauacggugaggcuuacacugacaccuaucacucuuacgccaagaacauucuuagaacacaagaauccgcauguaauugcaucggcggggauuguuaucugaugauuacugacggacccgcuucaggcguuagcgagugcagguuuuugaaaauccgggagggucgcaucauuaaggaaauauucccuaccgggagagugaagcauacagaggaauguaccugcggauuugccaguaacaaaacgaucgagugugcgugcagggauaaucgguacacugccaagcgcccauucgucaaacucaacguggaaacagacaccgcagagauucgacugaugugcacugagacauauuuagauacccccagaccuaaugacggcucuaucacgggcccaugugaauccgauggggacaagggaagcgguggcauaaaagggggauuuguacaccagaggauggcuucgaagauuggccggugguacucucguaccauguccaaaacaaagcgcauggguauggggcuguauguuaaguacgacggcgaucccuggacugacucagaggcccucgcucuuaguggagugaugaucagcauggaggaaccgggcugguacuccuucggguuugaaaucaaagauaagaaaugcgacgucccuuguauuggaaucgagauggugcaugaugguggcaagaccacauggcacucugccgcaacugccauuuauugccugauggggagcggacaguugcuaugggacaccgugacaggcgucgauauggcucuguga

SEQ ID NO: 152228 - RNA, 1401 nt, Artificial Sequence
  derived and/or modified sequence opt3 from neuraminidase__InfluenzaB__AHL94442
augcugcccagcaccauccagacacucacucuuuuccugacguccggcgggguguuguuaucucuguacaugucagccagucuaagcuaucuccuguacuccgacauucuucugaaguuuucuagaaccgagauaacagcuccuaucaugccauuggauugcgcaaacgccucgaauguccaagcgguuaacaggucagcuacuaaaggagugaccccgcuccugcccgaaccugaguggacauauccacggcugagcugucccgguaguaccuuccagaaggcccucuuaauuuccccucaccgcuuuggcgaaacuaaaggaaauucugcaccacugaucauucgagagcccuucaucgccugcgggccuaaggaauguaaacauuuugcucuuacacacuacgcagcccagccaggcgguuauuacaacgggacccgugaggacagaaauaaguugaggcaucugauaagcguaaagcuaggaaaaaucccgacgguggagaacuccauuuuccacauggcugccuggucaggcagugcgugccaugauggccgggaauggacuuauaucggggucgacggacccgauagcaaugcacuccugaagauuaaauacggugaggccuacaccgacacauaucacucuuacgcuaagaacauccuucgcacucaggaauccgccuguaauugcauaggcggggauuguuaucugaugauuaccgacggaucagcaagcggcaucagugagugcagauuuuugaaaauuagggagggucggaucaucaaggaaauuuucccuacagggcgcgugaagcacaccgaggaauguacgugcggauuugcuucuaacaaaacuauagagugugccugccgagauaauuccuacacagcgaagagaccauucguuaaacucaacguggaaaccgacacugccgagaucaggcugaugugcacagagaccuauuuagauacgccccggccuaaugacggcagcauugcaggcccaugugaaucgaacggggaugagggaucugguggcaucaaagggggauuuguccaucaacguauggcuuccaagauaggccgcugguacucaagaaccaugaguaagacaaaaaggauggguauggggcuguaugugaaguacgacggcgaccccuggacugauagcgaagcccucgcucuuuccggaguaaugguuucuauggaggaaccgggcugguacagcuucggguuugagauuaaggacaaaaagugcgaugugccuuguaucggaaucgagaugguccacgacgguggcaaaaccacauggcauucagccgcaacugccauuuauugccugauggggaguggacaguugcuaugggauaccgugacaggcgugaauaugacccuguga

SEQ ID NO: 152229 - RNA, 1401 nt, Artificial Sequence; identical to SEQ ID NO: 152218
  derived and/or modified sequence opt3 from neuraminidase__InfluenzaB__AHL94464

SEQ ID NO: 152230 - RNA, 1401 nt, Artificial Sequence; identical to SEQ ID NO: 150833
  derived and/or modified sequence opt3 from neuraminidase__InfluenzaB__AHL94475

SEQ ID NO: 152231 - RNA, 1401 nt, Artificial Sequence; identical to SEQ ID NO: 152222
  derived and/or modified sequence opt3 from neuraminidase__InfluenzaB__AHL94486

SEQ ID NO: 152232 - RNA, 1401 nt, Artificial Sequence; identical to SEQ ID NO: 150833
  derived and/or modified sequence opt3 from neuraminidase__InfluenzaB__AHL94497

SEQ ID NO: 152233 - RNA, 1401 nt, Artificial Sequence; identical to SEQ ID NO: 152218
  derived and/or modified sequence opt3 from neuraminidase__InfluenzaB__AHL94508

SEQ ID NO: 152234 - RNA, 1401 nt, Artificial Sequence
  derived and/or modified sequence opt3 from neuraminidase__InfluenzaB__AHL94519
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaacugaauguagagacugauacagccgaaauccgauuaaugugcaccgacacguaucuggauacccccagaccuaacgacggcuccauuacagggccaugugagagcgauggagacaaggguucgggcgggauaaaaggaggcuuuguucaucaaaggauggagucuaagaucggucggugguacucccguacuaugucaaaaaccgaacgcauggggaugggccucuaugugaaguacgacggagaucccuggacagacagugaugcacuugcuuucagcggcgucaugguguccaugaaggagccggggugguacucuuuuggauucgaaauuaaagacaagaaaugcgaugugccuuguaucgguauagagaugguccacgacggcgggaaggaaacuuggcauagcgccgcuaccgccauuuauugccugaugggaucaggccaguugcuaugggauacaguuaccgguguggacauggcacuguga

SEQ ID NO: 152235 - RNA, 1401 nt, Artificial Sequence; identical to SEQ ID NO: 152218
  derived and/or modified sequence opt3 from neuraminidase__InfluenzaB__AHL94530

SEQ ID NO: 152236 - RNA, 1401 nt, Artificial Sequence; identical to SEQ ID NO: 152222
  derived and/or modified sequence opt3 from neuraminidase__InfluenzaB__AHL94541

SEQ ID NO: 152237 - RNA, 1401 nt, Artificial Sequence
  derived and/or modified sequence opt3 from neuraminidase__InfluenzaB__AHL94563
augcugcccagcaccauccagacacucacucuuuuccugacguugggcgggguguuacugucccuauacgucucugccucacucaguuaucugcuuuacagcgacauucuguugaaguuuuccagaaccgagauaacagcuccuaucaugccacucgauugcgcaaacgccucuaauguucaagcggugaacaggucggcuacuaaaggaguaacccugcugcucccggaacccgaguggacauauccucgguuaucauguccagguagcaccuuccagaaggcccugcuuauuaguccccaccgcuuuggcgaaacuaaaggaaauuccgcaccuuugaucauucgagagccauucaucgccugcgggcccaaggaauguaaacauuuugcucugacacacuacgcagcccagccuggcgguuauuacaacgggacccgugaggacagaaauaagcuaaggcaucucauaucugugaagcugggaaaaaucccaacggucgagaacagcauuuuccacauggcugccugguccggcucagcgugccaugauggccgggaauggacuuauaucgggguggacggaccggauaguaaugcacuucugaagauuaaauacggugaggccuacaccgacacauaucacagcuacgcuaagaacaucuugcgcacucaggaaucugccuguaauugcauaggcggggauuguuaucucaugauuaccgacggacccgcauccggcaucucagagugcagauuucugaaaauuagggagggucggaucaucaaggaaauuuucccuacagggcgcguuaagcacaccgaggaauguacgugcggauuugcuagcaacaaaacuauagagugugccugccgagauaauaguuacacagcgaagagaccauucgugaaauuaaacgucgaaaccgacacugccgagaucaggcugaugugcacagagaccuaucucgauacgccccggccuaaugacggcucuauuaccggcccaugugaauccaacggggauaagggaagcgguggcaucaaagggggauuugugcaucaacguauggcaucgaagauaggccgcugguacucuagaacaauguccaaaacuaagaggauggguauggggcuuuauguaaaguacgacggcgaccccuggaccgauucagaggcucuggccuugaguggaguuauggugagcauggaggaaccgggcugguacuccuucggguuugaaauuaaagacaagaaaugcgaugucccuuguaucggaaucgagauggugcacgacgguggcaagacaacuuggcauucugcugccaccgcaauuuauugccuaauggggagcggacagcugcucugggauacagugaccggcgucaauaugacucuguga

SEQ ID NO: 152238 - RNA, 1401 nt, Artificial Sequence; identical to SEQ ID NO: 152191
  derived and/or modified sequence opt3 from neuraminidase__InfluenzaB__AHL94574

SEQ ID NO: 152239 - RNA, 1401 nt, Artificial Sequence
  derived and/or modified sequence opt3 from neuraminidase__InfluenzaB__AHL94585
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaucaaaggaaauuccgccccucuuauuauccgcgagccauucauagcuugcgggcccaccgaauguaagcauuuugcauugacucacuacgccgcucagccuggcgguuauuacaacgggacacgagaggaccguaauaaacugagacaucuaaucagcgugaagcucggaaagauuccaaccgucgagaacuccaucuuccacauggccgcguggucaggcagugcaugccaugauggcaaagaauggacguauauugggguggacggaccggauagcaaugcccugcuuaagaucaaauacggugaggcuuacacugacaccuaucacucuuacgccaagaacauacugaggacacaagaauccgcauguaauugcauuggcggggauuguuauuugaugaucacugacggacccgcuucaggcguuagcgagugccgguuucucaaaauucgcgaggguagaaucaucaaggaaauuuucccuaaggggagggugaaacacaccgaggaauguacaugcggauuugccaguaacaagaccauagagugugcgugccgggauaaucgcuacacggccaaacgaccauucgucaagcugaacguggaaacugacacagcagagaucagauuaaugugcaccgagacuuaucuggauacacccaggccuaaugacggcucuauuaccggcccaugugaauccgauggggacaaaggaagcgguggcaucaaagggggauuuguacaucagcggauggcuucgaagauaggccguugguacucucgcacgauguccaagaccaagagaauggguauggggcucuauguuaaauacgacggcgaucccuggacagacucagaggcccuugcucugaguggagugauggucagcauggaggaaccgggcugguacuccuucggguuugaaauuaaggauaaaaagugcgacgugccuuguaucggaaucgagauggugcacgaugguggcaaaacuaccuggcauucugccgcaacagccauuuauugcuugauggggagcggacagcuacugugggacacugucaccggcguugauauggcucucuga

SEQ ID NO: 152240 - RNA, 1401 nt, Artificial Sequence; identical to SEQ ID NO: 152191
  derived and/or modified sequence opt3 from neuraminidase__InfluenzaB__AHL94596

SEQ ID NO: 152241 - RNA, 1401 nt, Artificial Sequence
  derived and/or modified sequence opt3 from neuraminidase__InfluenzaB__AHL94607
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggcucaagucgaaaaucggucguugguacucucgcacuauguccaagaccgagagaauggggaugggccuuuaugugaaguacgacggagaucccugggcagacucagaugcucugacauucaguggcgucauggugagcaugaaagaaccggggugguacuccuuuggauucgagauuaaggacaaaaagugcgaugugccuuguaucgguauagaaaugguccacgacggcgggaaagagacuuggcauucugccgcuaccgccauuuauugcuugaugggaagcggccagcuacugugggauacaguuaccgguguggacauggcacucuga

SEQ ID NO: 152242 - RNA, 1401 nt, Artificial Sequence; identical to SEQ ID NO: 152222
  derived and/or modified sequence opt3 from neuraminidase__InfluenzaB__AHL94618

SEQ ID NO: 152243 - RNA, 1401 nt, Artificial Sequence; identical to SEQ ID NO: 152218
  derived and/or modified sequence opt3 from neuraminidase__InfluenzaB__AHL94628

SEQ ID NO: 152244 - RNA, 1401 nt, Artificial Sequence; identical to SEQ ID NO: 152222
  derived and/or modified sequence opt3 from neuraminidase__InfluenzaB__AHL94639

SEQ ID NO: 152245 - RNA, 1401 nt, Artificial Sequence
  derived and/or modified sequence opt3 from neuraminidase__InfluenzaB__AHL94650
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucagggagauuuucccuaccggacgggucaagcacacggaagaguguacuugcggcuuugcuaguaauaagacaaucgaaugugccugccgcgacaaccgauacaccgcgaaaagaccauucgugaagcugaauguagagacugauacagccgaaaucagguuaaugugcaccgacacguaucuggauacaccccggccuaacgacggcucuauuaccgggccaugugaguccgauggagacaaagguagcggcgggauaaagggaggcuuuguucaucaacguaugaaaucgaagaucggucgcugguacucuagaacuauguccaaaaccgagaggauggggaugggccucuaugugaaguacgacggagaucccugggcagacucagaugcucuugccuucaguggcgucauggugagcaugaaggaaccggggugguacuccuuuggauucgagauuaaagacaagaaaugcgaugugccuuguaucgguauagaaaugguccacgacggcgggaaggagacauggcauucugcugccacugcaauuuauugccugaugggaagcggccaguugcuaugggauaccguuacagguguggacauggcccuguga

SEQ ID NO: 152246 - RNA, 1401 nt, Artificial Sequence
  derived and/or modified sequence opt3 from neuraminidase__InfluenzaB__AHL94661
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggauccaacacacggaagaguguacuugcggcuuugcuaguaauaagacaauugaaugugccugccgggacaacucuuacaccgcgaaacgcccauucgugaagcugaaugucgagacugauacagccgaaauacgauuaaugugcaccaaaacguaucuggacacccccagaccugaggauggcuccaucacagggccaugugagagcaacggagguaagggcucugggggaauuaaaggcgguuuugugcaucagaggauggcaucgaagaucgggcggugguacucccguacuaugucaaaaaccgaacgcaagggcaugggacucuauguaaaguacaacggcgaccccugggcugauagugacgcccuuguuuucagcggggugauggucuccauggaggaaccgggaugguacucuuuugguuucgagauaaaagacaagaaaugcgaugugccuuguauuggcaucgaaauggugcacgacgggggaaaggagacauggcauagcgcugccacugcaaucuauugccugaugggcucaggucaguugcuaugggauaccgucacagggguuaauaugacccuguga

SEQ ID NO: 152247 - RNA, 1401 nt, Artificial Sequence
  derived and/or modified sequence opt3 from neuraminidase__InfluenzaB__AHL94672
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccccgcuccugcccgaaccugaguggacauauccacggcugagcugucccgguaguaccuuccagaaggcccucuuaauuuccccucaccgcuuuggcgaaacuaaaggaaauucugcaccacugaucauucgagagcccuucaucgccugcgggccuaaggaauguaaacauuuugcucuuacacacuacgcagcccagccaggcgguuauuacaacgggacccgugaggacagaaauaaguugaggcaucugauaagcgugaagcuaggaaaaaucccgacggucgagaacuccauuuuccacauggcugccuggucaggcagugcgugccaugauggccgggaauggacuuauaucgggguggacggacccgauagcaaugcacuccugaagauuaaauacggugaggccuacaccgacacauaucacucuuacgcuaagaacauccuucgcacucaggaauccgccuguaauugcauaggcggggauuguuaucugaugauuaccgacggaucagcaagcggcaucagugagugcagauuuuugaaaauuagggagggucggaucaucaaggaaauuuucccuacagggcgcguuaagcacaccgaggaauguacgugcggauuugcuucuaacaaaacuauagagugugccugccgagauaauuccuacacagcgaagagaccauucgugaaacucaacgucgaaaccgacacugccgagaucaggcugaugugcacagagaccuauuuagauacgccccggccuaaugacggcagcauuucgggcccaugugaaucuaacggggaugagggauccgguggcaucaaagggggauuugugcaucaacguauggcaucaaagauaggccgcugguacaguagaaccaugagcaagacaaaaaggauggguauggggcuguauguaaaguacgacggcgaccccuggacugauuccgaagcucucgcccuuucuggaguuauggugagcauggaggaaccgggcugguacucauucggguuugagauuaaggacaaaaagugcgaugucccuuguaucggaaucgagauggugcacgacgguggcaaaaccacauggcauagugcugccacugcaauuuauugccugaugggguccggacaguugcuaugggauaccgugacaggcgucaauaugacccuguga

SEQ ID NO: 152248 - RNA, 1401 nt, Artificial Sequence
  derived and/or modified sequence opt3 from neuraminidase__InfluenzaB__AHL94683
augcugcccagcaccauccagacacucacucuuuuccugacguccggcgggguguuguuaucucuguacgucucagccagucuaagcuaucuccuguacuccgacauucuucugaaguuuucuagaaccgagauaacagcuccuaucaugccauuggauugcgcaaacgccucgaauguucaagcggugaacaggucagcuacuaaaggaguaaccccgcuccugcccgaaccugaguggacauauccacggcugagcugucccgguaguaccuuccagaaggcccucuuaauuuccccucaccgcuuuggcgaaacuaaaggaaauucugcaccacugaucauucgagagcccuucaucgccugcgggccuaaggaauguaaacauuuugcucuuacacacuacgcagcccagccaggcgguuauuacaacgggacccgugaggacagaaauaaguugaggcaucugauaagcgugaagcuaggaaaaaucccgacggucgagaacuccauuuuccacauggcugccuggucaggcagugcgugccaugauggccgggaauggacuuauaucgggguggacggacccgauagcaaugcacuccugaagauuaaauacggugaggccuacaccgacacauaucacucuuacgcuaagaacauccuucgcacucaggaauccgccuguaauugcauaggcggggauuguuaucugaugauuaccgacggaucagcaagcggcaucagugagugcagauuuuugaaaauuagggagggucggaucaucaaggaaauuuucccuacagggcgcguuaagcacaccgaggaauguacgugcggauuugcuucuaacaaaacuauagagugugccugccgagauaauuccuacacagcgaagagaccauucgugaaacucaacgucgaaaccgacacugccgagaucaggcugaugugcacagagaccuauuuagauacgccccggccuaaugacggcagcauuaccggcccaugugaaucgaacgggggagaggguucuggcgggaucaagggaggcuuugugcaucaacguauggcauccaaaauaggucgcugguacucaagaacaaugaguaagacuaaaaggauggggaugggccuguauguaaaguacgauggagaccccuggaccgacagcgaagcucucgcccuuuccggcguuauggugucuauggaggaaccggggugguacagcuucggauuugagauuaaggauaaaaagugcgacgucccuuguaucgguaucgagauggugcacgauggcgggaaaacaacuuggcauucagcugccaccgcaauuuauugccugaugggaaguggccaguugcuaugggacacagugaccggugucaauaugacucuguga

SEQ ID NO: 152249 - RNA, 1401 nt, Artificial Sequence
  derived and/or modified sequence opt3 from neuraminidase__InfluenzaB__AHL94694
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccucuaugugaaguacgacggagaucccugggcagacucagaugcucuuacauucaguggcgucauggugagcaugaaagaaccggggugguacuccuuuggauucgagauuaaggacaaaaagugcgaugugccuuguaucgguauagaaaugguccacgacggcgggaaagagacuuggcauucugccgcuaccgccauuuauugccugaugggaagcggccaguugcuaugggauacaguuaccgguguggacauggcacuguga

SEQ ID NO: 152250 - RNA, 1401 nt, Artificial Sequence; identical to SEQ ID NO: 152222
  derived and/or modified sequence opt3 from neuraminidase__InfluenzaB__AHL94705

SEQ ID NO: 152251 - RNA, 1401 nt, Artificial Sequence; identical to SEQ ID NO: 150833
  derived and/or modified sequence opt3 from neuraminidase__InfluenzaB__AHL94716

SEQ ID NO: 152252 - RNA, 1401 nt, Artificial Sequence
  derived and/or modified sequence opt3 from neuraminidase__InfluenzaB__AHL94727
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacaccucgaauguucaagccgugaacagaucagcgacaaaaggaguaacccuccugcugcccgaaccugaguggacuuauccaaggcucagcugucccgguaguacauuccagaaggcuuuacugaucuccccucaccgguuuggcgaaaccaaaggaaauucugccccacuuauuauccgcgagcccuucauugcaugcgggccuaaggaauguaaacauuuugccuugacgcacuacgcugcacagccaggcgguuauuacaacgggacucgaggagaccguaauaagcugagacaucuaaucagcgugaagcucggcaaaauaccgaccgucgagaacuccaucuuccacauggccgcuuggucaggcagugccugccaugaugggaaggaguggacauauauuggaguggacggucccgauaauaacgcgcugcuuaaaaucaaguacggcgaagcauacacugacaccuaucacagcuacgccaauaacauucugaggacacaggagucugcuuguaauugcaucgggggaaacuguuauuugaugauaaccgauggcuccgccucagguguuagcgaaugccgguuucucaaaauucgcgaggggagaaucauuaaggagaucuucccuacgggaaggauccaacacacugaagaguguacaugcggcuuugcaaguaauaagaccauugaaugugcuugccgggacaacucuuacacugccaaacgcccauucgugaagcugaaugucgagacagauaccgcggaaauacgauuaaugugcacgaaaaccuaucuggacacacccagaccugaggauggcuccaucacugggccaugugagagcaacggagguaagggcucugggggaauuaaaggcgguuuugugcaucagaggauggccucgaagaucgggcggugguacucccguaccaugucaaaaacagaacgcaagggcaugggacucuauguaaaguacaacggcgaccccugggcagauagugacgcucuuguuuucagcggggugauggucuccauggaggaaccgggaugguacucuuuugguuucgagauaaaagacaagaaaugcgaugugccuuguauuggcaucgaaauggugcacgacgggggaaaggagacuuggcauagcgccgcuaccgccaucuauugccugaugggcucaggucaguugcuaugggauacagucaccgggguuaauaugacucuguga

SEQ ID NO: 152253 - RNA, 1401 nt, Artificial Sequence; identical to SEQ ID NO: 150833
  derived and/or modified sequence opt3 from neuraminidase__InfluenzaB__AHL94738

SEQ ID NO: 152254 - RNA, 1401 nt, Artificial Sequence
  derived and/or modified sequence opt3 from neuraminidase__InfluenzaB__AHL94749
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccucuaugugaaguacgacggagaucccugggcagacucagaugcucuugccuucaguggcgucauggugagcaugaaagaaccggggugguacuccuuuggauucgagauuaaggacaaaaagugcgaugugccuuguaucggugucgaaaugguucacgacggcgggaaagagacauggcauucugcugccacugcaauauauugccugaugggaagcggccaguugcuaugggauaccgugacagguguagacauggcccuguga

SEQ ID NO: 152255 - RNA, 1401 nt, Artificial Sequence
  derived and/or modified sequence opt3 from neuraminidase__InfluenzaB__AHL94760
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcugccaaaggaguaacucuccugcugccggaacccgaguggaccuauccuagacucagcuguccagguaguacauuccagaaggcauuacugauuucuccccauagguuuggcgaaaucaaaggaaauuccgccccucuuauuauccgggagccauucauagcuugcgggcccaccgaauguaagcacuuugcauugacucauuacgccgcucagccuggcgguuauuacaacgggacacgcgaggaccgaaauaaacugcgucaccuaaucagcgugaagcucggaaagauuccaaccgucgagaacuccaucuuccauauggccgcguggucaggcagugcaugccacgauggcaaagaauggacguauauugggguggacggaccggauagcaaugcccugcuuaagaucaaauacggugaggcuuacacugacaccuaucacucuuacgccaagaacauacugagaacacaagaauccgcauguaauugcauuggcggggauuguuauuugaugaucacugacggacccgcuucaggcguuagcgagugcagguuucucaaaauucgggagggucgcaucaucaaggaaauuuucccuaccgggagagugaagcauacagaggaauguaccugcggauuugccaguaacaaaacgauagagugugcgugcagggauaaucgguacacugccaagcgcccauucgucaaacugaacguggaaacagacaccgcagagauccgauuaaugugcacugagacauaucuggauacccccagaccuaaugacggcucuauuacgggcccaugugaauccgauggggacaagggaagcgguggcaucaaagggggauuuguacaccagaggauggcuucgaagauaggccggugguacucucguaccauguccaaaacaaagcgcauggguauggggcucuauguuaaguacgacggcgaucccuggacugacucagaggcccuugcucugaguggagugauggucagcauggaggaaccgggcugguacuccuucggguuugaaauuaaagauaagaaaugcgacaucccuuguaucggaauugagauggugcaugaugguggcaagaccacauggcacucugccgcaacugccaucuauugcuugauggggagcggacagcuacugugggacaccgugacaggcgucgauauggcucucuga

SEQ ID NO: 152256 - RNA, 1401 nt, Artificial Sequence; identical to SEQ ID NO: 152222
  derived and/or modified sequence opt3 from neuraminidase__InfluenzaB__AHL94770

SEQ ID NO: 152257 - RNA, 1401 nt, Artificial Sequence; identical to SEQ ID NO: 152220
  derived and/or modified sequence opt3 from neuraminidase__InfluenzaB__AHL94781

SEQ ID NO: 152258 - RNA, 1401 nt, Artificial Sequence; identical to SEQ ID NO: 152218
  derived and/or modified sequence opt3 from neuraminidase__InfluenzaB__AHL94791

SEQ ID NO: 152259 - RNA, 1401 nt, Artificial Sequence; identical to SEQ ID NO: 152249
  derived and/or modified sequence opt3 from neuraminidase__InfluenzaB__AHL94801

SEQ ID NO: 152260 - RNA, 1401 nt, Artificial Sequence; identical to SEQ ID NO: 152218
  derived and/or modified sequence opt3 from neuraminidase__InfluenzaB__AHL94812

SEQ ID NO: 152261 - RNA, 1401 nt, Artificial Sequence; identical to SEQ ID NO: 152218
  derived and/or modified sequence opt3 from neuraminidase__InfluenzaB__AHL94821

SEQ ID NO: 152262 - RNA, 1401 nt, Artificial Sequence; identical to SEQ ID NO: 152222
  derived and/or modified sequence opt3 from neuraminidase__InfluenzaB__AHL94831

SEQ ID NO: 152263 - RNA, 1401 nt, Artificial Sequence
  derived and/or modified sequence opt3 from neuraminidase__InfluenzaB__AHL94840
augcugcccagcaccauccagacacucacucuuuuccugacguccggcgggguguuguuaucucuguacgucucagccagucuaagcuaucuccuguacuccgguauucuucugaaguuuucuagaaccgagauaacagcuccuaucaugccauuggacugcgcaaacgccucgaauguucaagcggugaacaggucagcuacuaaaggaguaacccuccugcugccggaacccgaguggacauauccucggcucagcuguccaggcaguaccuuccagaaggccuuacugauuucuccccaccgcuuuggggaaacuaaaggaaauuccgcaccucuuaucauucgagagccauucaucgccugcggccccaaggaauguaaacauuuugcuuugacacacuacgcagcccagccugguggguauuacaacggaacccgugaggauagaaauaagcugaggcaucuaauaagcgugaagcucggcaaaaucccaacggucgagaacuccauuuuccacauggcugccuggucaggcagugcgugccaugacgggcgggaauggacuuauaucggaguggaugguccggacagcaaugcacugcuuaagauuaaauacggcgaggccuacaccgauacauaucacucuuacgcuaagaacauccugcgcacucaggaauccgccuguaauugcauagggggagacuguuauuugaugauuaccgauggccccgcaucagguaucagcgagugcagauuucucaaaauuagggaggggcggaucaucaaggaaauuuucccuacaggacgcguuaagcacaccgaggaauguacgugcggcuuugcuaguaacaaaacuauagagugugccugccgagacaauucuuacacagcgaagagaccauucgugaaacugaacgucgaaaccgauacugccgagaucagguuaaugugcacagagaccuaucuggacacgccccggccuaaugauggcuccauuaccgggccaugugaaagcaacggagacaaggguucgggcgggaucaaaggaggcuuugugcaucaacguauggcaucuaagauaggucgcugguacuccagaacaaugucaaaaacuaagaggauggggaugggccucuauguaaaguacgauggagaccccuggaccgacagugaggcucuugcccugagcggcguuaugguguccauggaggaaccggggugguacucuuucggauuugaaauuaaagauaagaaaugcgacgucccuuguaucgguaucgagauggugcacgauggcgggaagacaacuuggcauagcgcugccaccgcaauuuauugcuugaugggaucaggccagcuacugugggacacagugaccggugucaauaugacucucuga

SEQ ID NO: 152264 - RNA, 1401 nt, Artificial Sequence
  derived and/or modified sequence opt3 from neuraminidase__InfluenzaB__AHL94851
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaaucaaaggaaauuccgcaccucuuauuauccgcgagccauucauagccugcgggcccacugaauguaagcauuuugcuuugacacacuacgcagcccagccuggcgguuauuacaacgggacccgagaggaccguaauaaacugagacaucuaaucagcgugaagcucggaaagauuccaacggucgagaacuccaucuuccacauggcugccuggucaggcagugcgugccaugauggcaaagaauggacuuauauugggguggacggaccggauagcaaugcacugcuuaagaucaaauacggugaggccuacaccgacacauaucacucuuacgcuaagaacauacugaggacucaagaauccgccuguaauugcauuggcggggauuguuauuugaugaucaccgacggacccgcaucaggcguuagcgagugccgguuucucaaaauucgcgaggguagaaucaucaaggaaauuuucccuacagggagggugaagcacaccgaggaauguacgugcggauuugcuaguaacaaaacuauagagugugccugccgggauaaucgcuacacagcgaagcgaccauucgucaaacugaacguggaaaccgacacugccgagaucagauuaaugugcacagagaccuaucuggauacgcccaggccuaaugacggcucuauuaccggcccaugugaauccgauggggacaagggaagcgguggcaucaaagggggauuuguacaucagcggaugacaucgaagauaggccguugguacucucgcacuauguccaaaaccaagagaauggguauggggcucuauguuaaguacgacggcgaucccuggacagacucagaggcacuugcucugaguggagugauggucagcauggaggaaccgggcugguacuccuucggguuugaaauuaaagauaagaaaugcgacgugccuuguaucggaaucgagauggugcacgaugguggcaagacuaccuggcauucugccgcuacagccauuuauugcuugauggggagcggacagcuacugugggacaccgucacuggcguugauauggcacucuga

SEQ ID NO: 152265 - RNA, 1401 nt, Artificial Sequence; identical to SEQ ID NO: 150651
  derived and/or modified sequence opt3 from neuraminidase__InfluenzaB__AHL94862

SEQ ID NO: 152266 - RNA, 1401 nt, Artificial Sequence; identical to SEQ ID NO: 150833
  derived and/or modified sequence opt3 from neuraminidase__InfluenzaB__AHL94873

SEQ ID NO: 152267 - RNA, 1401 nt, Artificial Sequence; identical to SEQ ID NO: 152137
  derived and/or modified sequence opt3 from neuraminidase__InfluenzaB__AHL94884

SEQ ID NO: 152268 - RNA, 1401 nt, Artificial Sequence; identical to SEQ ID NO: 150977
  derived and/or modified sequence opt3 from neuraminidase__InfluenzaB__AHL94893

SEQ ID NO: 152269 - RNA, 1401 nt, Artificial Sequence; identical to SEQ ID NO: 150977
  derived and/or modified sequence opt3 from neuraminidase__InfluenzaB__AHL94904

SEQ ID NO: 152270 - RNA, 1401 nt, Artificial Sequence
  derived and/or modified sequence opt3 from neuraminidase__InfluenzaB__AHL94915
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagugguaaacagaucagcgaccaaaggagugacacuccugcugcccgaaccugaguggaccuauccaaggcucagcugucccgguaguacuuuccagaaggcuuuacugaucuccccucaccgguuuggcgaaacaaaaggaaauucugccccacuuauuauccgcgagcccuucauugcaugcgggccuaacgaauguaagcauuuugccuugacccacuacgcugcacagccaggcgguuauuacaaugggacgcgaggagaccguaacaaacugagacaucuaaucagcgucaagcucggcaagauaccgacuguggaaaauuccaucuuccacauggccgcuuggucaggcagugccugccaugaugggaaagaguggaccuauauuggaguugacggucccgauaacaaugcgcugcuuaaggugaaauacggcgaggcauacacagacacuuaucacagcuacgccaacaagauccugaggacccaggagucugcuuguaauugcauugggggaaacuguuauuugaugaucacagauggcuccgccucaggugucagcgaaugccgguuucucaaaauacgcgaggggagaauuaucaaggagauuuucccuaccggaagggugaagcacacggaagaguguacuugcggcuuugcaaguaauaaaacaaucgaaugugcuugccgggacaacucuuacaccgccaagcgcccauucguaaaacugaauguugagacugauacagcggaaauccgauuaaugugcaccgacacguaucuggauacccccagaccugacgauggcuccauuacagggccaugugagagcaacggagacaaggguucgggcgggauaaaaggaggcuuugugcaucaaaggauggagucuaagaucggucggugguacucccguacuaugucaaaaaccgaacgcauggggaugggccucuaugucaaguacgacggagaucccugggccgacagugaugcacuugcuuucagcggcgugaugguguccaugaaggagccggggugguacucuuuuggauucgaaauuaaagacaagaaaugcgaugucccuuguaucgguauagagaugguucacgacggcgggaaggaaacauggcauagcgccgcuacugccauuuauugccugaugggaucaggccaguugcuaugggauaccgugacagguguagacauggcacuguga

SEQ ID NO: 152271 - RNA, 1401 nt, Artificial Sequence; identical to SEQ ID NO: 152137
  derived and/or modified sequence opt3 from neuraminidase__InfluenzaB__AHL94926

SEQ ID NO: 152272 - RNA, 1401 nt, Artificial Sequence
  derived and/or modified sequence opt3 from neuraminidase__InfluenzaB__AHL94937
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuuugccgcucgauugcgcaaacgccucgaauguucaagcggugaacagaucagcuaccaaaggaguaacacugcugcuccccgaaccugaguggaccuauccaagguuaagcugucccgguaguacuuuccagaaggcccugcuuaucuccccucaccgguuuggcgaaacaaaaggaaauucugcaccauugauuauccgcgagcccuucauugccugcgggccuaacgaauguaagcauuuugcucugacccacuacgcagcccagccaggcgguuauuacaaugggacgcgaggagaccguaacaaacuaagacaucucaucagcgugaagcugggcaagauaccgacugucgaaaauuccaucuuccacauggcugccuggucaggcagugcgugccaugaugggaaagaguggaccuauauuggaguggacggucccgauaacaaugcacuucugaagguuaaauacggcgaggccuacacagacacuuaucacagcuacgcuaacaagaucuugaggacccaggagucugccuguaauugcauugggggaaacuguuaucucaugaucacagauggcuccgcaucaggugugagcgaaugccgguuucugaaaauacgcgaggggagaauuaucaaggagauuuucccuaccggaagggucaagcacacggaagaguguacuugcggcuuugcuaguaauaaaacaaucgaaugugccugccgggacaacucuuacaccgcgaagcgcccauucgugaaauuaaauguagagacugauacagccgaaauccgacugaugugcaccgacacguaucucgauacccccagaccuaacgacggcuccauuacagggccaugugagagcaacggagauaaggguucgggcgggauaaaaggaggcuuuguucaucaaaggauggagucuaagaucggucggugguacucccguacuaugucaaaaaccgaacgcauggggaugggccuuuaugugaaguacgacggagaccccugggcagauagugacgcucuggccuucagcggcgucaugguguccaugaaggagccggggugguacucuuuuggauucgaaauuaaagauaagaaaugcgacgugccuuguaucgguauagagaugguccacgauggcgggaaggaaacauggcauagcgcugccacugcaauuuauugcuugaugggaucaggccagcuacugugggacaccguuacagguguggauauggcccucuga

SEQ ID NO: 152273 - RNA, 1401 nt, Artificial Sequence; identical to SEQ ID NO: 152156
  derived and/or modified sequence opt3 from neuraminidase__InfluenzaB__AHL94948

SEQ ID NO: 152274 - RNA, 1401 nt, Artificial Sequence; identical to SEQ ID NO: 150972
  derived and/or modified sequence opt3 from neuraminidase__InfluenzaB__AHL94959

SEQ ID NO: 152275 - RNA, 1401 nt, Artificial Sequence; identical to SEQ ID NO: 150972
  derived and/or modified sequence opt3 from neuraminidase__InfluenzaB__AHL94969

SEQ ID NO: 152276 - RNA, 1401 nt, Artificial Sequence; identical to SEQ ID NO: 150972
  derived and/or modified sequence opt3 from neuraminidase__InfluenzaB__AHL94978

SEQ ID NO: 152277 - RNA, 1401 nt, Artificial Sequence
  derived and/or modified sequence opt3 from neuraminidase__InfluenzaB__AHM00990
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaaccacucagcggcuaaaggaguaacccuccugcugccggaacccgaguggacauauccuagacucagcuguccagguaguaccuuccagaaggccuuacugauuucuccccauagguuuggcgaaaucaaaggaaauuccgcaccucuuauuauccgggagccauucauagccugcgggcccacugaauguaagcacuuugcuuugacacauuacgcagcccagccuggcgguuauuacaacgggacccgcgaggaccgaaauaaacugcgucaccuaaucagcgugaagcucggaaagauuccaacggucgagaacuccaucuuccauauggcugccuggucaggcagugcgugccacgauggcaaagaauggacuuauauugggguggacggaccggauagcaaugcacugcuuaagaucaaauacggugaggccuacaccgacacauaucacucuuacgcuaagaacauacugagaacucaagaauccgccuguaauugcauuggcggggauuguuauuugaugaucaccgacggacccgcaucaggcguuagcgagugcagguuucucaaaauucgggagggucgcaucaucaaggaaauuuucccuacagggagagugaagcauaccgaggaauguacgugcggauuugcuaguaacaaaacuauagagugugccugcagggauaaucgguacacagcgaagcgcccauucgucaaacugaacguggaaaccgacacugccgagauccgauuaaugugcacagagaccuaucuggauacgcccagaccuaaugacggcucuauuaccggcccaugugaauccgauggggacaagggaagcgguggcaucaaagggggauuuguacaccagaggauggcaucgaagauaggccggugguacucucguacaauguccaaaacuaagcgcauggguauggggcucuauguuaaguacgacggcgaucccuggaccgacucagaggcucuugcccugaguggagugauggucagcauggaggaaccgggcugguacuccuucggguuugaaauuaaagauaagaaaugcgacgugccuuguaucggaaucgagauggugcaugaugguggcaagacaacuuggcacucugcugccaccgcaauuuauugcuugauggggagcggacagcuacugugggacacagucaccggcguugauauggcccucuga

SEQ ID NO: 152278 - RNA, 1401 nt, Artificial Sequence; identical to SEQ ID NO: 152222
  derived and/or modified sequence opt3 from neuraminidase__InfluenzaB__AHM01001

SEQ ID NO: 152279 - RNA, 1401 nt, Artificial Sequence
  derived and/or modified sequence opt3 from neuraminidase__InfluenzaB__AHM01012
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccucuaugugaaguacgacggagaucccuggacagacucagaugcacuugcuuucaguggcgucauggugagcaugaaagaaccggggugguacuccuuuggauucgagauuaaggacaaaaagugcgaugugccuuguaucgguauagaaaugguccacgacggcgggaaagagacuuggcauucugccgcuaccgccauuuauugccugaugggaagcggccaguugcuaugggauacaguuaccgguguggacauggcacuguga

SEQ ID NO: 152280 - RNA, 1401 nt, Artificial Sequence; identical to SEQ ID NO: 152222
  derived and/or modified sequence opt3 from neuraminidase__InfluenzaB__AHM01023

SEQ ID NO: 152281 - RNA, 1401 nt, Artificial Sequence; identical to SEQ ID NO: 152222
  derived and/or modified sequence opt3 from neuraminidase__InfluenzaB__AHM01034

SEQ ID NO: 152282 - RNA, 1401 nt, Artificial Sequence
  derived and/or modified sequence opt3 from neuraminidase__InfluenzaB__AHM01045
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugguuggaccuauccaaggcucagcugucccggcaguacuuuccagaaggccuuacugaucuccccucaccgguuuggggagacaaaaggaaauucugcaccacuuauuauccgcgaacccuucauugccugcggcccuaacgaguguaagcauuuugcuuugacccacuacgcagcccagccagguggguauuacaauggaacgcgaggcgaccguaacaaacugagacaucuaaucagcgugaagcucggcaagauaccgacugucgaaaauuccaucuuccacauggcugccuggucagggagugcgugccaugauggaaaagaguggaccuauauugguguggacggccccgauaacaaugcacugcuuaagguuaaauacggggaggccuacacagacacuuaucacagcuacgcuaacaagauccugaggacccaggaaucugccuguaauugcauuggaggcaacuguuauuugaugaucacagaugguuccgcaucaggggugagcgagugccgguuucucaaaauacgcgaaggaagaauuaucaaggagauuuucccuaccggcagggucaagcacacggaggaauguacuugcggcuuugcuaguaauaaaacaaucgagugugccugccgggacaaccgcuacaccgcgaagcgaccauucgugaaacugaauguagaaacugauacagccgagaucagauuaaugugcaccgacacguaucuggauacccccaggccuaacgacgggucuauuacaggaccaugugaauccgauggugacaagggcagcgggggaauaaaaggcgguuuuguucaucaacggaugaagucgaaaaucgggcguugguacucucgcacuauguccaagaccgagagaaugggcaugggacucuaugugaaguacgacggcgaucccugggcagacucagaugcucuugccuucaguggggucauggugagcaugaaagagccgggaugguacuccuuugguuucgaaauuaaggacaaaaagugcgaugugccuuguaucggcauagagaugguccacgacgggggaaaagaaacauggcauucugcugccacugcaauuuauugccugaugggcagcggucaguugcuaugggauaccguugccgggguggacauggcucuguga

SEQ ID NO: 152283 - RNA, 1401 nt, Artificial Sequence
  derived and/or modified sequence opt3 from neuraminidase__InfluenzaB__AHM01056
augcugcccagcaccacacagacucucacgcuuuuccugaccuccggcgggguguuguuaucucuguacgucucagccagucuaagcuaucuccuguacuccgacauccuucugaaguuuucuccuacagagauuacugcuccaaccaugccguuggauugcgcaaacgccucgaauguucaagcggugaacagaucagcuacaaaaggaguaacccuccugcugcccgaaccugaguggacuuauccaaggcucagcugucccgguaguacauuccagaaggccuuacugauauccccucaccgguuuggcgaaaccaaaggaaauucugcaccacuuaucauucgcgagcccuucaucgccugcgggccuaacgaauguaagcauuuugcuuugacgcacuacgcagcccagccaggcgguuauuacaaugggacucgaggagaccguaacaaacugagacaucuaauuagcgugaagcucggcaagaucccgaccgucgaaaauuccauauuccacauggcugccuggucaggcagugcgugccaugaugggaaagaguggacauauaucggaguggacggucccgauaacaaugcacugcuuaagguuaaauacggcgaggccuacacugacaccuaucacagcuacgcuaacaagauucugaggacacaggagucugccuguaauugcaucgggggaaacuguuauuugaugauuaccgauggcuccgcaucaggugugagcgaaugccgguuucucaaaauccgcgaggggagaauaauuaaggagaucuucccuacgggaagggucaagcacacugaagaguguacaugcggcuuugcuaguaauaaaaccauugaaugugccugccgggacaaccgcuacacugcgaagcgaccauucgugaaacugaauguagagacagauaccgccgaaaucagauuaaugugcacggacaccuaucuggauacacccaggccuaacgacggcucuaucacugggccaugugaguccgauggagacaaggguagcggcgggauuaaaggaggcuuuguucaucaacggaugaagucgaaaauaggucguugguacucucgcaccauguccaagacagagagaauggggaugggccucuaugugaaguacgacggagaucccugggcagacucagaugcucuugucuucaguggcgugauggugagcaugaaagaaccggggugguacuccuuuggauucgagaucaaggacaaaaagugcgaugucccuuguauugguaucgaaaugguucacgacggcgggaaagagacuuggcauucugccgcuaccgccauauauugccugaugggaagcggccaguugcuaugggauacagugaccgguguagacauggcacuguga

SEQ ID NO: 152284 - RNA, 1401 nt, Artificial Sequence; identical to SEQ ID NO: 152222
  derived and/or modified sequence opt3 from neuraminidase__InfluenzaB__AHM01067

SEQ ID NO: 152285 - RNA, 1401 nt, Artificial Sequence; identical to SEQ ID NO: 152191
  derived and/or modified sequence opt3 from neuraminidase__InfluenzaB__AHM01078

SEQ ID NO: 152286 - RNA, 1401 nt, Artificial Sequence
  derived and/or modified sequence opt3 from neuraminidase__InfluenzaB__AHM01089
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcugccaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaagggucaagcacaccgaagaguguacgugcggcuuugccaguaauaaaacuaucgaaugugcgugccgggacaaccgcuacacagccaagcgaccauucgugaaacugaauguagagaccgauacugcagaaaucagauuaaugugcacagacaccuaucuggauacgcccaggccuaacgacggcucuauuaccgggccaugugaguccgauggagacaaggguagcggcgggauaaaaggaggcuuuguucaucaacggaugaagucgaaaaucggucguugguacucucgcacaauguccaagacugagagaauggggaugggccucuaugugaaguacgacggagaucccugggcugacucagaugcccuugcuuucaguggcgucauggugagcaugaaagaaccggggugguacuccuuuggauucgagauuaaggacaaaaagugcgaugugccuuguaucgguauagaaaugguccacgacggcgggaaagagaccuggcauucugccgcaacagccauuuauugccugaugggaagcggccaguugcuaugggauacuguuaccgguguggacauggcucuguga

SEQ ID NO: 152287 - RNA, 1401 nt, Artificial Sequence; identical to SEQ ID NO: 152191
  derived and/or modified sequence opt3 from neuraminidase__InfluenzaB__AHM01100

SEQ ID NO: 152288 - RNA, 1401 nt, Artificial Sequence; identical to SEQ ID NO: 152222
  derived and/or modified sequence opt3 from neuraminidase__InfluenzaB__AHM01111

SEQ ID NO: 152289 - RNA, 1401 nt, Artificial Sequence
  derived and/or modified sequence opt3 from neuraminidase__InfluenzaB__AHM01122
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaaagcuccugcugcccgaaccugaguggacauauccaaggcucagcugucccgguaguaccuuccagaaagccuuacugaucuccccucaccgguuuggcgaaacuaagggaaauucugcaccacuuauuauccgcgagcccuucauugccugcgggccuaacgaauguaaacauuuugcuuugacacacuacgcagcccagccaggcgguuauuacaaugggacccgaggagaccguaacaagcugagacaucuaaucagcgugaagcucggcaaaauaccgacggucgaaaauuccaucuuccacauggcugccuggucaggcagugcgugccaugaugggaaggaguggacuuauauuggaguggacggucccgauaacaaugcacugcuuaaaguuaaguacggcgaggccuacaccgacacauaucacagcuacgcuaacaaaauccugaggacucaggagucugccuguaauugcauugggggaaacuguuauuugaugaucaccgauggcuccgcaucaggugugagcgaaugccgguuucucaagauacgcgaggggagaauuaucaaggagauuuucccuacaggaagggucaaacacaccgaagaguguacgugcggcuuugcuaguaauaagacuaucgaaugugccugccgggacaaccgcuacacagcgaaacgaccauucgugaagcugaauguagagaccgauacugccgaaaucagauuaaugugcacagacaccuaucuggauacgcccaggccuaacgacggcucuauuaccgggccaugugaguccgauggagacaaagguagcggcgggauaaagggaggcuuuguucaucaacggaugaaaucgaagaucggucguugguacucucgcacaauguccaagacugagagaauggggaugggccucuaugugaaauacgacggagaucccugggcagacucagaugcucuugccuucaguggcgucauggugagcaugaaggaaccggggugguacuccuuuggauucgagauuaaagacaagaaaugcgaugugccuuguaucgguauagaaaugguccacgacggcgggaaggagaccuggcauucugcugccacagcaauuuauugccugaugggaagcggccaguugcuaugggauacuguuaccgguguggacauggcccuguga

SEQ ID NO: 152290 - RNA, 1401 nt, Artificial Sequence; identical to SEQ ID NO: 152222
  derived and/or modified sequence opt3 from neuraminidase__InfluenzaB__AHM01133

SEQ ID NO: 152291 - RNA, 1401 nt, Artificial Sequence
  derived and/or modified sequence opt3 from neuraminidase__InfluenzaB__AHM01144
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcugccaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucagguauaagcgaaugccgguuucucaaaauucgcgaggggagaaucauuaaggagaucuucccuacaggaagggugaagcacaccgaagaguguacgugcggcuuugccaguaauaaaacuaucgaaugugcgugccgggacaaccgcuacacagccaagcgaccauucgucaaacugaauguggagaccgauacugcagaaauuagauuaaugugcacagacaccuaucuggauacgcccaggccuaacgacggcucuauaaccgggccaugugaguccgauggagacaaggguagcggcgggaucaaaggaggcuuuguacaucaacggaugaagucgaaaauuggucguugguacucucgcacaauguccaagacugagagaauggggaugggccucuauguuaaguacgacggagaucccugggcugacucagaugcccuugcuuucaguggcgugauggucagcaugaaagaaccggggugguacuccuuuggauucgagaucaaggacaaaaagugcgaugugccuuguauagguauugaaauggugcacgacggcgggaaagagaccuggcauucugccgcaacagccaucuauugccugaugggaagcggccaguugcuaugggauacugucaccgguguugacauggcucuguga

SEQ ID NO: 152292 - RNA, 1401 nt, Artificial Sequence; identical to SEQ ID NO: 152222
  derived and/or modified sequence opt3 from neuraminidase__InfluenzaB__AHM01166

SEQ ID NO: 152293 - RNA, 1401 nt, Artificial Sequence
  derived and/or modified sequence opt3 from neuraminidase__InfluenzaB__AHM01188
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaaccacucagcuaccaaaggaguaacacuccugcugcccgaaccugaguggaccuauccaagacucagcugucccgguaguacuuuccagaaggccuuacugaucuccccucauagguuuggcgaaacaaaaggaaauucugcaccacuuauuauccgggagcccuucauugccugcgggccuaacgaauguaagcacuuugcuuugacccauuacgcagcccagccaggcgguuauuacaaugggacgcgcggagaccgaaacaaacugcgucaccuaaucagcgugaagcucggcaagauaccgacugucgaaaauuccaucuuccauauggcugccuggucaggcagugcgugccacgaugggaaagaguggaccuauauuggaguggacggucccgauaacaaugcacugcuuaagguuaaauacggcgaggccuacacagacacuuaucacagcuacgcuaacaagauccugagaacccaggagucugccuguaauugcauugggggaaacuguuauuugaugaucacagauggcuccgcaucaggugugagcgaaugcagguuucucaaaauacgggaggggcgcauuaucaaggagauuuucccuaccggaagagucaagcauacggaagaguguacuugcggcuuugcuaguaauaaaacaaucgaaugugccugcagggacaaccgguacaccgcgaagcgcccauucgugaaacugaauguagagacugauacagccgaaauccgauuaaugugcaccgacacguaucuggauacccccagaccuaacgacggcucuauuacagggccaugugaguccgauggagacaaggguagcggcgggauaaaaggaggcuuuguucaccaaaggaugaagucgaaaaucggucggugguacucucguacuauguccaagaccgagcgcauggggaugggccucuaugugaaguacgacggagaucccugggcagacucagaugcucuugucuucaguggcgugauggugagcaugaaagaaccggggugguacuccuuuggauucgagauuaaggacaaaaagugcgaugucccuuguaucgguauagaaaugguucaugacggcgggaaagagacauggcacucugccgcuacugccauuuauugccugaugggaagcggccaguugcuaugggauaccgugacagguguagacauggcacuguga

SEQ ID NO: 152294 - RNA, 1401 nt, Artificial Sequence; identical to SEQ ID NO: 152286
  derived and/or modified sequence opt3 from neuraminidase__InfluenzaB__AHM01199

SEQ ID NO: 152295 - RNA, 1401 nt, Artificial Sequence
  derived and/or modified sequence opt3 from neuraminidase__InfluenzaB__AHM01210
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugguuggaccuauccaaggcucagcugucccggcaguacuuuccagaaggccuuacugaucuccccucaccgguuuggggaggcaaaaggaaauucugccccacuuauuauccgcgaacccuucauugcuugcggcccuaacgaguguaagcauuuugcauugacacacuacgccgcucagccagguggguauuacaauggaacccgaggcgaccguaacaaacugagacaucuaaucagcgugaagcucggcaagauaccgacggucgaaaauuccaucuuccacauggccgcguggucagggagugcaugccaugauggaaaagaguggacuuauauugguguggacggccccgauaacaaugcccugcuuaagguuaaauacggggaggcuuacaccgacacauaucacagcuacgccaacaagauccugaggacucaggaaucugcauguaauugcauuggaggcaacuguuauuugaugaucaccgaugguuccgcuucaggggugagcgagugccgguuucucaaaauacgcgaaggaagaauuaucaaggagauuuucccuacaggcagggucaagcacaccgaggaauguacgugcggcuuugccaguaauaaaacuaucgagugugcgugccgggacaaccgcuacacagccaagcgaccauucgugaaacugaauguagaaaccgauacugcagagaucagauuaaugugcacagacaccuaucuggauacgcccaggccuaacgacgggucuauuaccggaccaugugaauccgauggugacaagggcagcgggggaauaaaaggcgguuuuguucaucaacggaugaagucgaaaaucgggcguugguacucucgcacaauguccaagacugagagaaugggcaugggacucuaugugaaguacgacggcgaucccugggcugacucagaugcccuugcuuucaguggggucauggugagcaugaaagagccgggaugguacuccuuugguuucgaaauuaaggacaaaaagugcgaugugccuuguaucggcauagagaugguccacgacgggggaaaagaaaccuggcauucugccgcaacagccauuuauugccugaugggcagcggucaguugcuaugggauacuguugcugggguggacauggcgcuguga

SEQ ID NO: 152296 - RNA, 1401 nt, Artificial Sequence
  derived and/or modified sequence opt3 from neuraminidase__InfluenzaB__AHM01221
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauuuccaagcgguuaacagaucagcuaccaaaggagugacauuucuccugcccgaaccugaguggaccuauccaaggcugagcugucccgguaguacuuuccagaaggcccucuuaaucuccccucaccgguuuggcgaaacaaaaggaaauucugcaccacugauuauccgcgagcccuucauugccugcgggccuaacgaauguaagcauuuugcucuuacccacuacgcagcccagccaggcgguuauuacaaugggacgcgaggagaccguaacaaauugagacaucugaucagcguaaagcuaggcaagauaccgacuguggaaaauuccaucuuccacauggcugccuggucaggcagugcgugccaugaugggaaagaguggaccuauauuggagucgacggucccgauaacaaugcacuccugaaggugaaauacggcgaggccuacacagacacuuaucacagcuacgcuaacaagauccuuaggacccaggagucugccuguaauugcauugggggaaacuguuaucugaugaucacagauggcuccgcaucagguguuagcgaaugccgguuuuugaaaauacgcgaggggagaauuaucaaggagauuuucccuaccggaagggugaagcacacggaagaguguacuugcggcuuugcuaguaauaaaacaaucgaaugugccugccgggacaaccgcuacaccgcgaagcgaccauucgucaaacucaauguggagacugauacagccgaaaucagacugaugugcaccgacacguauuuagauacccccaggccuaacgacggcucuauuacagggccaugugaguccgauggagacaaggguagcggcgggauaaaaggaggcuuuguacaucaacggaugaagucgaaaaucggucguugguacucucgcacuauguccaagaccgagagaauggggaugggccuguauguuaaguacgacggagaucccugggcagacucagaugcucucgccuucaguggcgugauggucagcaugaaagaaccggggugguacuccuucggauuugagauuaaggacaaaaagugcgaugugccuuguaucgguauagaaauggugcacgacggcgggaaagagacauggcauucugcugccacugcaauuuauugccuuaugggaagcggccagcuguugugggauaccgucacagguguugacauggcccuauga

SEQ ID NO: 152297 - RNA, 1401 nt, Artificial Sequence; identical to SEQ ID NO: 152191
  derived and/or modified sequence opt3 from neuraminidase__InfluenzaB__AHM01232

SEQ ID NO: 152298 - RNA, 1401 nt, Artificial Sequence; identical to SEQ ID NO: 152222
  derived and/or modified sequence opt3 from neuraminidase__InfluenzaB__AHM01243

SEQ ID NO: 152299 - RNA, 1401 nt, Artificial Sequence
  derived and/or modified sequence opt3 from neuraminidase__InfluenzaB__AHM01254
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccucuaugugaaguacgacggagaucccugggcagacucagaugcucuugucuucaguggcgugauggugagcaugaaagaaccggggugguacuccuuuggauucgagauuaaggacaaaaagugcgaugucccuuguaucgguauagaaaugguucacgacggcgggaaagagacauggcauucugccgcuacugccauuuauugccugaugggaagcggccaguugcuaugggauaccgugacagguguagacauggcacuguga

SEQ ID NO: 152300 - RNA, 1401 nt, Artificial Sequence
  derived and/or modified sequence opt3 from neuraminidase__InfluenzaB__AHM01265
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacgaggguagcggcgggauaaagggaggcuuuguucaucaacggaugaaaucgaagaucggucguugguacucucgcacuauguccaaaaccgaaagaauggggaugggccucuaugugaaguacgacggagaucccugggcagacucagaugcucuugccuucaguggcgucauggugagcaugaaggagccggggugguacuccuuuggauucgaaauuaaagacaagaaaugcgaugugccuuguaucgguauagagaugguccacgacggcgggaaggaaacauggcauucugcugccacugcaauuuauugccugaugggaagcggcagguugcuaugggauaccguuacagguguggacauggcccuguga

SEQ ID NO: 152301 - RNA, 1401 nt, Artificial Sequence
  derived and/or modified sequence opt3 from neuraminidase__InfluenzaB__AHM01276
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaaucaaaggaaauuccgcaccucuuauuauccgcgagccauucauagccugcgggcccacugaauguaagcauuuugcuuugacacacuacgcagcccagccuggcgguuauuacaacgggacccgagaggaccguaauaaacugagacaucuaaucagcgugaagcucggaaagauuccaacggucgagaacuccaucuuccacauggcugccuggucaggcagugcgugccaugauggcaaagaauggacuuauauugggguggacggaccggauagcaaugcacugcuuaagaucaaauacggugaggccuacaccgacacauaucacucuuacgcuaagaacauacugaggacucaagaauccgccuguaauugcauuggcggggauuguuauuugaugaucaccgacggacccgcaucaggcguuagcgagugccgguuucucaaaauucgcgaggguagaaucaucaaggaaauuuucccuacagggagggugaagcacaccgaggaauguacgugcggauuugcuaguaacaaaacuauagagugugccugccgggauaaucgcuacacagcgaagcgaccauucgucaaacugaacguggaaaccgacacugccgagaucagauuaaugugcacagagaccuaucuggauacgcccaggccuaaugacggcucuauuaccggcccaugugaauccgauggggacaagggaagcgguggcaucaaagggggauuuguacaucagcggauggcaucgaagauaggccguugguacucucgcacaauguccaaaacuaagagaauggguauggggcucuauguuaaguacgacggcgaucccuggaccgacucagaggcucuugcccugaguggagugauggucagcauggaggaaccgggcugguacuccuucggguuugaaauuaaagauaagaaaugcgacgugccuuguaucggaaucgagauggugcacgaugguggcaagacaacuuggcauucugcugccaccgcaauuuauugcuugauggggagcggacagcuacugugggacacagucaccggcguugauauggcccucuga

SEQ ID NO: 152302 - RNA, 1401 nt, Artificial Sequence; identical to SEQ ID NO: 152286
  derived and/or modified sequence opt3 from neuraminidase__InfluenzaB__AHM01287

SEQ ID NO: 152303 - RNA, 1401 nt, Artificial Sequence; identical to SEQ ID NO: 152286
  derived and/or modified sequence opt3 from neuraminidase__InfluenzaB__AHM01298

SEQ ID NO: 152304 - RNA, 1401 nt, Artificial Sequence; identical to SEQ ID NO: 152301
  derived and/or modified sequence opt3 from neuraminidase__InfluenzaB__AHM01309

SEQ ID NO: 152305 - RNA, 1401 nt, Artificial Sequence; identical to SEQ ID NO: 152222
  derived and/or modified sequence opt3 from neuraminidase__InfluenzaB__AHM01320

SEQ ID NO: 152306 - RNA, 1401 nt, Artificial Sequence; identical to SEQ ID NO: 152286
  derived and/or modified sequence opt3 from neuraminidase__InfluenzaB__AHM01331

SEQ ID NO: 152307 - RNA, 1401 nt, Artificial Sequence; identical to SEQ ID NO: 152222
  derived and/or modified sequence opt3 from neuraminidase__InfluenzaB__AHM01342

SEQ ID NO: 152308 - RNA, 1401 nt, Artificial Sequence
  derived and/or modified sequence opt3 from neuraminidase__InfluenzaB__AHM01353
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugguuggaccuauccaaggcucagcugucccggcaguacuuuccagaaggccuuacugaucuccccucaccgguuuggggagacaaaaggaaauucugcaccacuuauuauccgcgaacccuucauugccugcggcccuaacgaguguaagcauuuugcuuugacccacuacgcagcccagccagguggguauuacaauggaacgcgaggcgaccguaacaaacugagacaucuaaucagcgugaagcucggcaagauaccgacugucgaaaauuccaucuuccacauggcugccuggucagggagugcgugccaugauggaaaagaguggaccuauauugguguggacggccccgauaacaaugcacugcuuaagguuaaauacggggaggccuacacagacacuuaucacagcuacgcuaacaagauccugaggacccaggaaucugccuguaauugcauuggaggcaacuguuauuugaugaucacagaugguuccgcaucaggggugagcgagugccgguuucucaaaauacgcgaaggaagaauuaucaaggagauuuucccuaccggcagggucaagcacacggaggaauguacuugcggcuuugcuaguaauaaaacaaucgagugugccugccgggacaaccgcuacaccgcgaagcgaccauucgugaaacugaauguagaaacugauacagccgagaucagauuaaugugcaccgacacguaucuggauacccccaggccuaacgacgggucuauuacaggaccaugugaauccgauggugacaagggcagcgggggaauaaaaggcgguuuuguucaucaacggaugaagucgaaaaucgggcguugguacucucgcacuauguccaagaccgagagaaugggcaugggacucuaugugaaguacgacggcgaucccugggcagacucagaugcucuugccuucaguggggucauggugagcaugaaagagccgggaugguacuccuuugguuucgaaauuaaggacaaaaagugcgaugugccuuguaucggcauagagaugguccacgacgggggaaaagaaacauggcauucugcugccacugcaauuuauugccugaugggcagcggucaguugcuaugggauaccguuacagggguggacauggcccuguga

SEQ ID NO: 152309 - RNA, 1401 nt, Artificial Sequence
  derived and/or modified sequence opt3 from neuraminidase__InfluenzaB__AHM01364
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacgaggguagcggcgggauaaagggaggcuuuguucaucaacggaugaaaucgaagaucggucguugguacucucgcacuauguccaaaaccgaaagaauggggaugggccucuaugugaaguacgacggagaucccugggcagacucagaugcucuugccuucaguggcgucauggugagcaugaaggagccggggugguacuccuuuggauucgaaauuaaagacaagaaaugcgaugugccuuguaucgguauagagaugguccacgacggcgggaaggaaacauggcauucugcugccacugcaauuuauugccugaugggaagcggccaguugcuaugggauaccguuacagguguggacauggcccuguga

SEQ ID NO: 152310 - RNA, 1401 nt, Artificial Sequence; identical to SEQ ID NO: 152301
  derived and/or modified sequence opt3 from neuraminidase__InfluenzaB__AHM01375

SEQ ID NO: 152311 - RNA, 1401 nt, Artificial Sequence; identical to SEQ ID NO: 152301
  derived and/or modified sequence opt3 from neuraminidase__InfluenzaB__AHM01386

SEQ ID NO: 152312 - RNA, 1401 nt, Artificial Sequence; identical to SEQ ID NO: 152222
  derived and/or modified sequence opt3 from neuraminidase__InfluenzaB__AHM01397

SEQ ID NO: 152313 - RNA, 1401 nt, Artificial Sequence; identical to SEQ ID NO: 152222
  derived and/or modified sequence opt3 from neuraminidase__InfluenzaB__AHM01408

SEQ ID NO: 152314 - RNA, 1401 nt, Artificial Sequence; identical to SEQ ID NO: 152222
  derived and/or modified sequence opt3 from neuraminidase__InfluenzaB__AHM01419

SEQ ID NO: 152315 - RNA, 1401 nt, Artificial Sequence
  derived and/or modified sequence opt3 from neuraminidase__InfluenzaB__AHM01430
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacgaggguagcggcgggauaaagggaggcuuuguucaucaacggaugaaaucgaagaucggucguugguacucucgcacuauguccaaaaccgaaagaauggggaugggccucuaugugaaguacgacggagaucccugggcagacucagaugcucuugccuucaguggcgucauggugagcaugaaggagccggggugguacuccuuuggauucgaaauuaaagacaagaaaugcgaugugccuuguaucgguauagagaugguccacgacggcgggaaggaaacauggcauucugcugccacugcaauuuauugccugaugggaagcggcagguugcuaugggauaccgccacagguguugacauggcucuguga

SEQ ID NO: 152316 - RNA, 1401 nt, Artificial Sequence
  derived and/or modified sequence opt3 from neuraminidase__InfluenzaB__AHM01441
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuacuaugccauuggauugcgcaaacgccucgaauguucaggcggugaacagaucagcugccaaaggaguaacccuccugcugccggaacccgaguggacauauccuaggcucagcuguccagguaguaccuuccagaaggcauuacugaucucuccccaccgguuuggcgaaauuaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcguuagcgagugccgguuucucaaaauccgcgaggguagaauuaucaaggaaaucuucccuacagggagggugaagcacaccgaggaauguacgugcggauuugccaguaacaaaacuauugagugugcgugccgggauaaucgcuacacagccaagcgaccauucgucaaacugaacguggaaaccgacacugcagagauaagauuaaugugcacagagaccuaucuggauacgcccaggccuaaugacggcucuaucaccggcccaugugaauccgauggggacaagggaagcgguggcauuaaagggggauuuguacaucagcggauggcuucgaagaucggccguugguacucucgcacaauguccaaaacuaagagaauggguauggggcucuauguuaaguacgacggcgaucccuggaccgacucagaggcccuugcucugaguggagugauggucagcauggaggaaccgggcugguacuccuucggguuugaaauaaaagauaagaaaugcgacgugccuuguauuggaaucgagauggugcacgaugguggcaagacaacuuggcauucugccgcaaccgccaucuauugcuugauggggagcggacagcuacugugggacacagucaccggcguugauauggcucucuga

SEQ ID NO: 152317 - RNA, 1401 nt, Artificial Sequence; identical to SEQ ID NO: 152222
  derived and/or modified sequence opt3 from neuraminidase__InfluenzaB__AHM01463

SEQ ID NO: 152318 - RNA, 1401 nt, Artificial Sequence
  derived and/or modified sequence opt3 from neuraminidase__InfluenzaB__AHM01474
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcauuaacgcaucgaauguucaggccgugaacagaucagcggcuaaaggaguaacucuccugcugccggaacccgaguggaccuauccuaggcucagcuguccagguaguacauuccagaaggccuuacugaucucuccccaccgguuuggcgaaauuaaaggaaauuccgcaccucuuaucauacgcgagccauucaucgccugcgggcccaccgaauguaagcauuuugcuuugacucacuacgcagcccagccuggcgguuauuacaacgggacacgagaggaccguaauaaacugagacaucuaauuagcgugaagcucggaaagaucccaaccgucgagaacuccauuuuccacauggcugccuggucaggcagugcgugccaugauggcaaagaauggacguauaucgggguggacggaccggauagcaaugcacugcuuaagauaaaauacggugaggccuacacugacaccuaucacucuuacgcuaagaacauucugaggacacaagaauccgccuguaauugcaucggcggggauuguuauuugaugauuacugacggacccgcaucaggcguuagcgagugccgguuucucaaaauccgcgaggguagaaucauuaaggaaauauucccuaccgggagggugaagcacacagaggaauguaccugcggauuugcuaguaacaaaacgaucgagugugccugccgggauaaucgcuacacugcgaagcgaccauucgucaaacugaacguggaaacagacaccgccgagauuagauuaaugugcacugagacauaucuggauacccccaggccuaaugacggcucuaucacgggcccaugugaauccgauggggacaagggaagcgguggcauaaaagggggauuuguacaucagcggauggcaucgaagauuggccguugguacucucgcaccauguccaaaacaaagagaauggguauggggcucuauguuaaguacgacggcgaucccuggacugacucagaggcucuugcccugaguggagugauggucagcauggaggaaccgggcugguacuccuucggguuugaaaucaaagauaagaaaugcgacgugccuuguaucggaauugagauggugcacgaugguggcaagaccacauggcauucugcugccacugcaaucuauugcuugauggggagcggacagcuacugugggacaccgucacaggcguugauauggcccucuga

SEQ ID NO: 152319 - RNA, 1401 nt, Artificial Sequence
  derived and/or modified sequence opt3 from neuraminidase__InfluenzaB__AHM01485
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaaucaugccguuggauugcacuaacgcaucgaauguucaagccgugaacagaucagcggcuaaaggaguaacccuccugcugcccgaaccugaguggacauauccaaggcucagcugucccgguaguaccuuccagaaggccuuacugauuuccccucaccgguuuggcgaaaucaaaggaaauucugcaccacuuauuauccgcgagcccuucauagccugcgggccuacugaauguaagcauuuugcuuugacacacuacgcagcccagccaggcgguuauuacaacgggacccgagaggaccguaauaaacugagacaucuaaucagcgugaagcucggaaagauuccgacggucgagaacuccaucuuccacauggcugccuggucaggcagugcgugccaugauggcaaagaauggacuuauauugggguggacggacccgauagcaaugcacugcuuaagaucaaauacggugaggccuacaccgacacauaucacucuuacgcuaagaacauacugaggacucaggaauccgccuguaauugcauuggcggggauuguuauuugaugaucaccgacggaccugcaucaggcguuagcgagugccgguuucucaaaauucgcgaggguagaaucaucaaggaaauuuucccaacagggagggugaagcacaccgaggaauguacgugcggauuugcuaguaacaaaacuauagagugugccugccgggauaaucgcuacacagcgaagcgacccuucgucaaacugaacguggaaaccgacacugccgagaucagauuaaugugcacagagaccuaucuggauacgccuaggccaaaugacggcucuauuaccggccccugugaauccgauggggacaagggaagcgguggcaucaaagggggauuuguacaucaacggauggcaucgaagauaggccguugguacucucgcacaauguccaaaacuaagagaauggguauggggcucuauguuaaguacgacggcgauccguggaccgacucagaggcucuugcccugaguggagugauggucagcauggaggaaccuggcugguacuccuucggguuugaaauuaaagauaagaaaugcgacgugcccuguaucggaaucgagauggugcacgaugguggcaagacaacuuggcauucugcugccaccgcaauuuauugcuugauggggagcggacagcuacugugggacacagucaccggcguugauauggcccucuga

SEQ ID NO: 152320 - RNA, 1401 nt, Artificial Sequence; identical to SEQ ID NO: 152301
  derived and/or modified sequence opt3 from neuraminidase__InfluenzaB__AHM01496

SEQ ID NO: 152321 - RNA, 1401 nt, Artificial Sequence
  derived and/or modified sequence opt3 from neuraminidase__InfluenzaB__AHM01507
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaucaaaggaaauuccgccccucuuauugugcgcgagccauucaucgcuugcgggcccaccgaauguaagcauuuugcauugacucacuacgccgcucagccuggcgguuauuacaacgggacacgagaggaccguaauaaacugagacaucuaauaagcgucaagcucggaaagaucccaaccguggagaacuccauuuuccacauggccgcguggucaggcagugcaugccaugauggcaaagaauggacguauaucgggguugacggaccggauagcaaugcccugcuuaagauuaaauacggugaggcuuacacugacaccuaucacucuuacgccaagaacauccugaggacacaagaauccgcauguaauugcauaggcggggauuguuauuugaugauuacugacggacccgcuucaggcgugagcgagugccgguuucucaaaauccgcgaggguagaauuaucaaggaaaucuucccuaccgggagggucaagcacacagaggaauguaccugcggauuugccaguaacaaaacgauugagugugcgugccgggauaaucgcuacacugccaagcgaccauucgugaaacugaacguagaaacagacaccgcagagauaagauuaaugugcacugagacauaucuggauacccccaggccuaaugacggcucuaucacgggcccaugugaauccgauggggacaagggaagcgguggcauuaaagggggauuuguucaucagcggauggcuucgaagaucggccguugguacucucgcaccauguccaaaacaaagagaauggguauggggcucuaugugaaguacgacggcgaucccuggacugacucagaggcccuugcucugaguggagucauggugagcauagaggaaccgggcugguacuccuucggguuugaaauuaaagauaagaaaugcgacgugccuuguaucggaaucgagaugguccacgaugguggcaagaccacauggcauucugccgcaacugccauuuauugcuugauggggagcggacagcuacugugggacaccguuacaggcguggauauggcucucuga

SEQ ID NO: 152322 - RNA, 1401 nt, Artificial Sequence; identical to SEQ ID NO: 152301
  derived and/or modified sequence opt3 from neuraminidase__InfluenzaB__AHM01518

SEQ ID NO: 152323 - RNA, 1401 nt, Artificial Sequence
  derived and/or modified sequence opt3 from neuraminidase__InfluenzaB__AHM01529
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaaucaaaggaaauuccgcaccucuuauuauccgcgagccauucauagccugcgggcccacugaauguaagcauuuugcuuugacacacuacgcagcccagccuggcgguuauuacaacgggacccgagaggaccguaauaaacugagacaucuaaucagcgugaagcucggaaagauuccaacggucgagaacuccaucuuccacauggcugccuggucaggcagugcgugccaugauggcaaagaauggacuuauauugggguggacggaccggauagcaaugcacugcuuaagaucaaauacggugaggccuacaccgacacauaucacucuuacgcuaagaacauacugaggacucaagaauccgccuguaauugcauuggcggggauuguuauuugaugaucaccgacggacccgcaucaggcguuagcgagugccgguuucucaaaauucgcgaggguagaaucaucaaggaaauucugccuacagggagggugaagcacaccgaggaauguacgugcggauucgcuaguaacaaaacuauagagugugccugccgggauaaucgcuacacagcgaagcgaccauuugucaaauuaaacguggaaaccgacacugccgagaucagacugaugugcacagagaccuaucucgauacgcccaggccuaaugacggcucuauuaccggcccaugugaauccgauggggacaagggaagcgguggcaucaaagggggauucguacaucagcggauggcaucgaagauaggccguugguacucucgcacaauguccaaaacuaagagaauggguauggggcuuuauguuaaguacgacggcgaucccuggaccgacucagaggcucuggccuugaguggagugauggucagcauggaggaaccgggcugguacuccuuuggguucgaaauuaaagauaagaaaugcgacgugccuuguaucggaaucgagauggugcacgaugguggcaagacaacuuggcauucugcugccaccgcaauuuauugccuaauggggagcggacagcugcucugggacacagucaccggcguugauauggcccuguga

SEQ ID NO: 152324 - RNA, 1401 nt, Artificial Sequence; identical to SEQ ID NO: 152191
  derived and/or modified sequence opt3 from neuraminidase__InfluenzaB__AHM01540

SEQ ID NO: 152325 - RNA, 1401 nt, Artificial Sequence; identical to SEQ ID NO: 152301
  derived and/or modified sequence opt3 from neuraminidase__InfluenzaB__AHM01551

SEQ ID NO: 152326 - RNA, 1401 nt, Artificial Sequence; identical to SEQ ID NO: 152301
  derived and/or modified sequence opt3 from neuraminidase__InfluenzaB__AHM01562

SEQ ID NO: 152327 - RNA, 1401 nt, Artificial Sequence; identical to SEQ ID NO: 150808
  derived and/or modified sequence opt3 from neuraminidase__InfluenzaB__AHZ13597

SEQ ID NO: 152328 - RNA, 1404 nt, Artificial Sequence
  derived and/or modified sequence opt3 from neuraminidase__InfluenzaB__AHZ36701
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcugcccgaaccugaguggacauauccaaggcucagcugucccgguaguaccuuucaaaaggccuuacugaucuccccucaucgguucggcgaaacuaaaggaaauucugcaccacuuauuauccgcgagcccuuuauugccugcgggccuaacgaauguaagcacuucgcuuugacacauuacgcagcccagccaggcgguuauuacaaugggacccgaggagaccguaacaaacugagacaccuaaucagcgugaagcucggcaagauaccgacggucgaaaauuccaucuuucauauggcugccuggucaggcagugcgugccacgaugggaaagaguggacuuauauuggaguggacggucccgauaacaaugcacugcuuaagaucaaauacggcgaggccuacaccgacacauaucacagcuacgcuaacaauauucugaggacucaggagucugccuguaacugcaucgggggaaauuguuauuugaugauaaccgauggcuccgcaucagguguuagcgaaugccgguuccucaagauucgcaaagggagaaucauuaaggagaucuuuccuacaggaagggugaagcauaccgaggaauguacgugcggcuucgcuaguaacaaaacuaucgagugugccugccgggacaauucuuacacagcgaagcgcccauuugucaaacugaacguggaaaccgauacugccgagauucgauuaaugugcacagacaccuaucuggauacgcccagaccugacgauggcuccauaaccgggccaugugaaagcaacggagacaaggguucgggcgggaucaaaggaggcuucguacaccagaggauggcaucuaagauuggucggugguacucccguacaaugucaaaaacugagcgcauggggaugggccucuauguuaaguacgacggagaucccuggaccgacagugaugcucuugccuuuagaggcgugauggucagcaugaaggagccggggugguacuccuucggauucgaaaucaaagacaagaaaugcgaugugccuuguauagguauugagauggugcaugacggcgggaaggaaacauggcacucugcugccacugcaaucuauugccugaugggaagcggccaauugcuaugggauaccgucacagguguugacauggcccuguga

SEQ ID NO: 152329 - RNA, 1404 nt, Artificial Sequence
  derived and/or modified sequence opt3 from neuraminidase__InfluenzaB__AHZ36756
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcugcccgaaccugaguggacauauccaaggcucagcugucccgguaguaccuuucaaaaggccuuacugaucuccccucaucgguucggcgaaacuaaaggaaauucugcaccacuuauuauccgcgagcccuuuauugccugcgggccuaacgaauguaagcacuucgcuuugacacauuacgcagcccagccaggcgguuauuacaaugggacccgaggagaccguaacaaacugagacaccuaaucagcgugaagcucggcaagauaccgacggucgaaaauuccaucuuucauauggcugccuggucaggcagugcgugccacgaugggaaagaguggacuuauauuggaguggacggucccgauaacaaugcacugcuuaagaucaaauacggcgaggccuacaccgacacauaucacagcuacgcuaacaauauucugaggacucaggagucugccuguaacugcaucgggggaaauuguuauuugaugauaaccgauggcuccgcaucagguguuagcgaaugccgguuccucaagauucgcgaggggagaaucauuaaagagaucuuuccuacaggaagggugaagcauaccgaagaguguacgugcggcuucgcuaguaacaagacuaucgaaugugccugccgggacaauucuuacacagcgaaacgcccauuugucaagcugaacguggagaccgauacugccgaaauucgauuaaugugcacagacaccuaucuggauacgcccagaccugacgauggcuccauaaccgggccaugugagagcaacggagacaaagguucgggcgggaucaagggaggcuucguacaccagaggauggcaucuaaaauuggucggugguacucccguacaaugucaaagacugagcgcauggggaugggccucuauguuaaauacgacggagaucccuggaccgacagugaugcucuugccuuuagaggcgugauggucagcaugaaggaaccggggugguacuccuucggauucgagaucaaggacaaaaagugcgaugugccuuguauagguauugaaauggugcaugacggcgggaaagagacauggcacucugcugccacugcaaucuauugccugaugggaagcggccaauugcuaugggauaccgucacagguguugacauggcccuguga

SEQ ID NO: 152330 - RNA, 1401 nt, Artificial Sequence
  derived and/or modified sequence opt3 from neuraminidase__InfluenzaB__AHZ36767
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuagaccguuggauugcgcaaacgccucgaauguucaagcggugaacaggucagcuaccaaaggaguaacacuccugcugcccgaaccugaguggaccuauccacggcucagcugucccgguaguacuuuccagaaggccuuacugaucuccccucaccgcuuuggcgaaacaaaaggaaauucugcaccacuuauuauccgagagcccuucauugccugcgggccuaacgaauguaagcauuuugcuuugacccacuacgcagcccagccaggcgguuauuacaaugggacgcguggagacagaaacaaacugaggcaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugcggacccaggagucugccuguaauugcauugggggaaacuguuauuugaugaucacagauggcuccgcaucaggugugagcgaaugccgcuuucucaaaauaagagaggggaggauuaucaaggagauuuucccuaccggacgggucaagcacacggaagaguguacuugcggcuuugcuaguaauaaaacaaucgaaugugccugccgcgacaaccgauacaccgcgaagagaccauucgugaaacugaauguagagacugauacagccgaaaucagguuaaugugcaccgacacguaucuggauacaccccggccuaacgacggcucuauuaccgggccaugugaguccgauggagacaaggguagcggcgggauaaaaggaggcuuuguucaucaacguaugaagucgaaaaucggucgcugguacucuagaacuauguccaagaccgagaggauggggaugggccucuaugugaaguacgacggagaucccugggcagacucagaugcucuugccuucaguggcgucauggugagcaugaaagaaccggggugguacuccuuuggauucgagauuaaggacaaaaagugcgaugugccuuguaucgguauagaaaugguccacgacggcgggaaagagacauggcauucugcugccacugcaauuuauugccugaugggaagcggccaguugcuaugggauaccguuacagguguggacauggcccuguga

SEQ ID NO: 152331 - RNA, 1401 nt, Artificial Sequence
  derived and/or modified sequence opt3 from neuraminidase__InfluenzaB__AHZ36778
augcugcccagcaccauccagacacucacucuuuuccugacguccggcgggguguuguuaucucuguacgucucagccagucuaagcuaucuccuguacuccgacauucuucugaaguuuccuucuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaaggaauguaaacauuuugcuuugacccacuacgcagcccagccaggcgguuauuacaacgggacgcgaggagaccguaauaagcugagacaucuaaucagcgugaagcucggcaaaauaccgacugucgagaacuccaucuuccacauggcugccuggucaggcagugcgugccaugaugggaaggaguggaccuauauuggaguggacggucccgauaauaacgcacugcuuaaaaucaaguacggcgaagccuacacagacacuuaucacagcuacgcuaauaacauucugaggacccaggagucugccuguaauugcaucgggggaaacuguuauuugaugauaacagauggcuccgcaucagguguuagcgaaugccgguuucucaaaauucgcgaggggagaaucauuaaggagaucuucccuaccggaaggauccaacacacggaagaguguacuugcggcuuugcuaguaauaagacaauugaaugugccugccgggacaacucuuacaccgcgaaacgcccauucgugaagcugaaugucgagacugauacagccgaaauacgauuaaugugcaccaaaacguaucuggacacccccagaccugaggauggcuccaucacagggccaugugagagcaacggagguaagggcucugggggaauuaaaggcgguuuugugcaucagaggauggcaucgaagaucgggcggugguacucccguacuaugucaaaaaccgaacgcaagggcaugggacucuauguaaaguacaacggcgaccccugggcugauagugacgcccuuguuuucagcggggugaugauauccauggaggaaccgggaugguacucuuuugguuucgagauuaaagacaagaaaugcgaugucccuuguaucggcaucgaaauggugcacgacgggggaaaggagacauggcauagcgcugccacugcaauuuauugccugaugggcucaggucaguugcuaugggauaccgugacaggggucaauaugacccuguga

SEQ ID NO: 152332 - RNA, 1401 nt, Artificial Sequence
  derived and/or modified sequence opt3 from neuraminidase__InfluenzaB__AHZ36789
augcugcccagcaccauccagacacucacucuuuuccugacguccggcgggguguuguuaucucuguacgucucagccagucuaagcuaucuccuguacuccgacauucuucugaaguuuucuccuaccgagauaacagcucaaacuaugccauuggauugcgcaaacgccucgaauguucaggcggugaacagaucagcuaccaaaggaguaacacuccugccgcccgaaccugaguggaccuauccaaggcugagcugucccgguaguacuuuccagaaggcccucuuaaucuccccucaccgguuuggcgaaacaaaaggaaauucugcaccacugauuauccgcgagcccuucauugccugcgggccuaacgaauguaagcauuuugcucuuacccacuacgcagcccagccaggcgguuauuacaaugggacgcgaggagaccguaacaaauugagacaucugaucagcgugaagcuaggcaagauaccgacugucgaaaauuccaucuuccacauggcugccuggucaggcagugcgugccaugaugggaaagaguggaccuauauuggaguggacggucccgauaacaaugcacuccugaagguuaaauacggcgaggccuacacagacacuuaucacagcuacgcuaacaagauccuuaggacccaagagucugccuguaauugcauugggggaaacuguuaucugaugaucacagauggcuccgcaucaggugugagcgaaugccgguuuuugaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacucaauguagagacugauacagccgaaaucagacugaugugcaccgacacguauuuagauacccccaggccuaacgacggcucuauuacagggccaugugaguccgauggagacaaggguagcggcgggauaaaaggaggcuuuguucaucagcggaugaagucgaaaaucggucguugguacucucgcacuauguccaagaccgagagaauggggaugggccuguaugugaaguacgacggagaucccugggcagacucagaugcucucgccuucaguggcgucauggugagcaugaaagaaccggggugguacuccuuuggauucgagaugaaggacaaaaagugcgaugugccuuguauugguaucgaaaugguccacgacggcgggaaagagacauggcauucugcugccacugcaauauauugccuuaugggaagcggccagcuguugugggauaccguuacagguguggacauggcccuauga

SEQ ID NO: 152333 - RNA, 1401 nt, Artificial Sequence; identical to SEQ ID NO: 152332
  derived and/or modified sequence opt3 from neuraminidase__InfluenzaB__AHZ36800

SEQ ID NO: 152334 - RNA, 1401 nt, Artificial Sequence
  derived and/or modified sequence opt3 from neuraminidase__InfluenzaB__AHZ36811
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcacuaacgcaucgaauguucaggccgugaacagaucagcggcuaaaggaguaacccuccugcugccggaacccgaguggacauauccuaggcucagcuguccagguaguaccuuccagaaggccuuacugauuucuccccaccgguuuggcgaaaucaaaggaaauuccgcaccucuuauuauccgcgagccauucauagccugcgggcccacugaauguaagcauuuugcuuugacacacuacgcagcccagccuggcgguuauuacaacgggacccgagaggaccguaauaaacugagacaucuaaucagcgugaagcucggaaagauuccaacggucgagaacuccaucuuccacauggcugccuggucaggcagugcgugccaugauggcaaagaauggacuuauauugggguggacggaccggauagcaaugcacugcuuaagaucaaauacggugaggccuacaccgacacauaucacucuuacgcuaagaacauacugaggacucaagaauccgccuguaauugcauuggcggggauuguuauuugaugaucaccgacggacccgcaucaggcguuagcgagugccgguuucucaaaauucgcgaggguagaaucaucagggaaauuuucccuacagggcgggugaagcacaccgaggaauguacgugcggauuugcuaguaacaagacuauagagugugccugccgcgauaaucgauacacagcgaaaagaccauucgucaagcugaacguggaaaccgacacugccgagaucagguuaaugugcacagagaccuaucuggauacgccccggccuaaugacggcucuauuaccggcccaugugaauccgauggggacaaaggaagcgguggcaucaaagggggauuuguacaucagcguauggcaucgaagauaggccgcugguacucuagaacaauguccaagacuaaaaggauggguauggggcucuauguuaaguacgacggcgaucccuggaccgacucagaggcucuugcccugaguggagugauggucagcauggaggaaccgggcugguacuccuucggguuugaaauuaaggauaaaaagugcgacgugccuuguaucggaaucgagauggugcacgaugguggcaaaacaacuuggcauucugcugccaccgcaauuuauugcuugauggggagcggacagcuacugugggacacagucaccggcguugauauggcccucuga

SEQ ID NO: 152335 - RNA, 1404 nt, Artificial Sequence; identical to SEQ ID NO: 152329
  derived and/or modified sequence opt3 from neuraminidase__InfluenzaB__AHZ36822

SEQ ID NO: 152336 - RNA, 1401 nt, Artificial Sequence
  derived and/or modified sequence opt3 from neuraminidase__InfluenzaB__AHZ36833
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuagaccguuggauugcgcaaacgccucgaauguucaagcggugaacaggucagcuaccaaaggaguaacacuccugcugcccgaaccugaguggaccuauccacggcucagcugucccgguaguacuuuccagaaggccuuacugaucuccccucaccgcuuuggcgaaacaaaaggaaauucugcaccacuuauuauccgagagcccuucauugccugcgggccuaacgaauguaagcauuuugcuuugacccacuacgcagcccagccaggcgguuauuacaaugggacgcguggagacagaaacaaacugaggcaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugcggacccaggagucugccuguaauugcauugggggaaacuguuauuugaugaucacagauggcuccgcaucaggugugagcgaaugccgcuuucucaaagucagagaggggaggauaauuaaggagaucuucccuaccggacgggugaagcacacggaagaguguacuugcggcuuugcuaguaauaaaacaauugaaugugccugccgcgacaaccgauacaccgcgaagagaccauucguaaaacugaauguugagacugauacagccgaaaucagguuaaugugcaccgacacguaucuggauacaccccggccuaacgacggcucuaucaccgggccaugugaguccgauggagacaaggguagcggcgggauuaaaggaggcuuugugcaucaacguaugaagucgaaaauaggucgcugguacucuagaacuauguccaagaccgagaggauggggaugggccucuaugucaaguacgacggagaucccugggcagacucagaugcucuugccuucaguggcgugauggugagcaugaaagaaccggggugguacuccuuuggauucgagaucaaggacaaaaagugcgaugucccuuguauugguaucgaaaugguucacgacggcgggaaagagacauggcauucugcugccacugcaauauauugccugaugggaagcggccaguugcuaugggauaccgugacagguguagacauggcccuguga

SEQ ID NO: 152337 - RNA, 1401 nt, Artificial Sequence
  derived and/or modified sequence opt3 from neuraminidase__InfluenzaB__AHZ36844
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuagaccguuggauugcgcaaacgccucgaauguucaagcggugaacaggucagcuaccaaagaaguaacacuccugcugcccgagccugaauggaccuauccacggcucagcugucccggaaguacuuuccagaaggccuuacugaucuccccucaccgcuuuggugagacaaaaggcaauucugcaccacuuauuauccgagaacccuucauugccugcgggccuaacgaguguaagcauuuugcuuugacccacuacgcagcccagccaggaggcuauuacaaugguacgcguggggacagaaacaaacugaggcaucuaaucagcgugaagcucggaaagauaccgacugucgaaaauuccaucuuccacauggcugccuggucaggcagugcgugccaugauggcaaagaguggaccuauauugggguggacggacccgauaacaaugcacugcuuaagguuaaauacggugaggccuacacagacacuuaucacagcuacgcuaacaagauccugcggacccaggaaucugccuguaauugcauuggcgggaacuguuauuugaugaucacagauggauccgcaucaggcgugagcgagugccgcuuucucaaaauaagagaggguaggauuaucaaggaaauuuucccuaccgggcgggucaagcacacggaggaauguacuugcggauuugcuaguaauaaaacaaucgagugugccugccgcgacaaccgauacaccgcgaagagaccauucgugaaacugaauguagaaacugauacagccgagaucagguuaaugugcaccgacacguaucuggauacaccccggccuaacgacggcucuauuaccggcccaugugaguccgauggggacaagggaagcgguggcauaaaagggggauuuguucaucaacguaugaagucgaaaaucggccgcugguacucuagaacuauguccaagaccgaaaggauggguauggggcucuaugugaaguacgacggcgaucccugggcagacucagaugcucuugccuucaguggagucauggugagcaugaaagagccgggcugguacuccuuuggguucgaaauuaaggacaaaaagugcgaugugccuuguaucggaauagagaugguccacgacgguggcaaagaaacauggcauucugcugccacugcaauuuauugccugauggggagcggacaguugcuaugggauaccguuacaggcguggacauggcccuguga

SEQ ID NO: 152338 - RNA, 1401 nt, Artificial Sequence
  derived and/or modified sequence opt3 from neuraminidase__InfluenzaB__AHZ36855
augcugcccagcaccauccagacacucacucuuuuccugacguccggcgggguguuguuaucucuguacgucucagccagucuaagcuaucuccuguacuccgacauucuucugaaguuuucuccuaccgagauaacaguucaaacuaugccauuggauugcgcuaacgcaucgaaugugcaggccguaaacagaucagcgaccaaaggagugacacuccugccgcccgaaccugaguggaccuauccaaggcugagcugucccgguaguacuuuccagaaggcucucuuaaucuccccucaccgguuuggcgaaacaaaaggaaauucugccccacugauuauccgcgagcccuucauugcaugcgggccuaacgaauguaagcauuuugcccuuacccacuacgcugcacagccaggcgguuauuacaaugggacgcgaggagaccguaacaaauugagacaucugaucagcgucaagcuaggcaagauaccgacuguggaaaauuccaucuuccacauggccgcuuggucaggcagugccugccaugaugggaaagaguggaccuauauuggaguugacggucccgauaacaaugcgcuccugaaggugaaauacggcgaggcauacacagacacuuaucacagcuacgccaacaagauccuuaggacccaagagucugcuuguaauugcauugggggaaacuguuaucugaugaucacagauggcuccgccucaggugucagcgaaugccgguuuuugaaaauacgcgaggggagaauuaucaaggagauuuucccuaccggaagggugaagcacacggaagaguguacuugcggcuuugcaaguaauaaaacaaucgaaugugcuugccgggacaaccgcuacaccgccaagcgaccauucguaaaacucaauguugagacugauacagcggaaaucagacugaugugcaccgacacguauuuagauacccccaggccuaacgacggcucuauuacagggccaugugaguccgauggagacaaggguagcggcgggauaaaaggaggcuuugugcaucagcggaugaagucgaaaaucggucguugguacucucgcacuauguccaagaccgagagaauggggaugggccuguaugucaaguacgacggagaucccugggccgacucagaugcacucgcuuucaguggcgugauggugagcaugaaagaaccggggugguacuccuuuggauucgagaugaaggacaaaaagugcgaugucccuuguauugguaucgaaaugguucacgacggcgggaaagagacauggcauucugccgcuacugccauauauugccuuaugggaagcggccagcuguugugggauaccgugacagguguagacauggcacuauga

SEQ ID NO: 152339 - RNA, 1404 nt, Artificial Sequence; identical to SEQ ID NO: 152329
  derived and/or modified sequence opt3 from neuraminidase__InfluenzaB__AHZ36866

SEQ ID NO: 152340 - RNA, 1401 nt, Artificial Sequence
  derived and/or modified sequence opt3 from neuraminidase__InfluenzaB__AHZ36877
augcugcccagcaccauccagacacucacucuuuuccugacguccggcgggguguuguuaucucuguacgucucagccagucuaagcuaucuccuguacuccgacauucuucugaaguuuucuccuccagagauaaccgcuccgacaaugcccuuggauugcgcaaacgccucgaauguucaagcggugaacagaucagcuacuaaaggaguaacccuccugcugccugaaccagaguggacauaucccaggcucagcuguccugguaguaccuuccagaaggccuuacugaucuccccacaccgguuuggcgaaacuaaaggaaauucugcaccccuuauuauccgcgagccuuucauugccugcgggccaaacgaauguaagcauuuugcuuugacacacuacgcagcccagccgggcgguuauuacaaugggacccgaggagaccguaacaaacugagacaucuaaucagcgugaagcucggcaagauacccacggucgaaaauuccaucuuccacauggcugccuggucaggcagugcgugccaugaugggaaagaguggacuuauauuggaguggacgguccugauaacaaugcacugcuuaagguuaaauacggcgaggccuacaccgacacauaucacagcuacgcuaacaagauccugaggacucaggagucugccuguaauugcauugggggaaacuguuauuugaugaucaccgauggcuccgcaucaggugugagcgaaugccgguuucucaaaauacgcgaggggagaauuaucaaggagauuuucccaacaggaagggucaagcacaccgaagaguguacgugcggcuuugcuaguaauaaaacuaucgaaugugccugccgggacaaccgcuacacagcgaagcgacccuucgugaaacugaauguagagaccgauacugccgaaaucagauuaaugugcacagacaccuaucuggauacgccuaggccaaacgacggcucuauuaccgggcccugugaguccgauggagacaaggguagcggcgggauaaaaggaggcuuuguucaucaacggaugaagucgaaaaucggucguugguacucucgcacaauguccaagacugagagaauggggaugggccucuaugugaaguacgacggagauccgugggcagacucagaugcucuugccuucaguggcgucauggugagcaugaaagaaccugggugguacuccuuuggauucgagauuaaggacaaaaagugcgaugugcccuguaucgguauagaaaugguccacgacggcgggaaagagaccuggcauucugcugccacagcaauuuauugccugaugggaagcggccaguugcuaugggauacuguuaccgguguggacauggcccuguga

SEQ ID NO: 152341 - RNA, 1404 nt, Artificial Sequence; identical to SEQ ID NO: 152329
  derived and/or modified sequence opt3 from neuraminidase__InfluenzaB__AHZ36888

SEQ ID NO: 152342 - RNA, 1404 nt, Artificial Sequence; identical to SEQ ID NO: 152329
  derived and/or modified sequence opt3 from neuraminidase__InfluenzaB__AHZ36899

SEQ ID NO: 152343 - RNA, 1404 nt, Artificial Sequence; identical to SEQ ID NO: 152329
  derived and/or modified sequence opt3 from neuraminidase__InfluenzaB__AHZ36910

SEQ ID NO: 152344 - RNA, 1401 nt, Artificial Sequence; identical to SEQ ID NO: 152331
  derived and/or modified sequence opt3 from neuraminidase__InfluenzaB__AHZ36921

SEQ ID NO: 152345 - RNA, 1401 nt, Artificial Sequence
  derived and/or modified sequence opt3 from neuraminidase__InfluenzaB__AHZ36932
augcugcccagcaccauccagacacucacucuuuuccugacguccggcgggguguuguuaucucuguacgucucagccagucuaagcuaucuccuguacuccgacauucuucugaaguuuucuccuaccgagauaacagcucaaacuaugccauuggauugcgcaaacgccucgaauguucaggcggugaacagaucagcuaccaaaggaguaacacuccugccgcccgaaccugaguggaccuauccaaggcugagcugucccgguaguacuuuccagaaggcccucuuaaucuccccucaccgguuuggcgaaacaaaaggaaauucugcaccacugauuauccgcgagcccuucauugccugcgggccuaacgaauguaagcauuuugcucuuacccacuacgcagcccagccaggcgguuauuacaaugggacgcgaggagaccguaacaaauugagacaucugaucagcgugaagcuaggcaagauaccgacugucgaaaauuccaucuuccacauggcugccuggucaggcagugcgugccaugaugggaaagaguggaccuauauuggaguggacggucccgauaacaaugcacuccugaagguuaaauacggcgaggccuacacagacacuuaucacagcuacgcuaacaagauccuuaggacccaagagucugccuguaauugcauugggggaaacuguuaucugaugaucacagauggcuccgcaucaggugugagcgaaugccgguuuuugaaaauacgcgaggggagaauuaucaaggagauuuucccuaccggaagggucaagcacacggaagaguguacuugcggcuuugcuaguaauaaaacaauggaaugugccugccgggacaaccgcuacaccgcgaagcgaccauucgugaaacucaauguagagacugauacagccgaaaucagacugaugugcaccgacacguauuuagauacccccaggccuaacgacggcucuaucacagggccaugugaguccgauggagacaaggguagcggcgggauuaaaggaggcuuuguucaucagcggaugaagucgaaaauaggucguugguacucucgcacuauguccaagaccgagagaauggggaugggccuguaugugaaguacgacggagaucccugggcagacucagaugcucucgccuucaguggcgucauggugagcaugaaagaaccggggugguacuccuuuggauucgagaugaaggacaaaaagugcgaugugccuuguaucgguauugaaaugguccacgacggcgggaaagagacauggcauucugcugccacugcaaucuauugccuuaugggaagcggccagcuguugugggauaccguuacagguguggacauggcccuauga

SEQ ID NO: 152346 - RNA, 1401 nt, Artificial Sequence
  derived and/or modified sequence opt3 from neuraminidase__InfluenzaB__AHZ36943
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcccccugaaccagaguggaccuaucccaggcugagcuguccugguaguacuuuccagaaggcccucuuaaucuccccacaccgguuuggcgaaacaaaaggaaauucugcaccccugauuauccgcgagccuuucauugccugcgggccaaacgaauguaagcauuuugcucuuacccacuacgcagcccagccgggcgguuauuacaaugggacgcgaggagaccguaacaaauugagacaucugaucagcgugaagcuaggcaagauacccacugucgaaaauuccaucuuccacauggcugccuggucaggcagugcgugccaugaugggaaagaguggaccuauauuggaguggacgguccugauaacaaugcacuccugaagguuaaauacggcgaggccuacacagacacuuaucacagcuacgcuaacaagauccuuaggacccaggagucugccuguaauugcauugggggaaacuguuaucugaugaucacagauggcuccgcaucaggugugagcgaaugccgguuuuugaaaauacgcgaggggagaauuaucaaggagauuuucccaaccggaagggucaagcacacggaagaguguacuugcggcuuugcuaguaauaaaacaaucgaaugugccugccgggacaaccgcuacaccgcgaagcgacccuucgugaaacucaauguagagacugauacagccgaaaucagacugaugugcaccgacacguauuuagauaccccuaggccaaacgacggcucuauuacagggcccugugaguccgauggagacaaggguagcggcgggauaaaaggaggcuuuguucaucaacggaugaagucgaaaaucggucguugguacucucgcacuauguccaagaccgagagaauggggaugggccuguaugugaaguacgacggagauccgugggcagacucagaugcucucgccuucaguggcgucauggugagcaugaaagaaccugggugguacuccuuuggauucgagaugaaggacaggaaaugcgaugugcccuguauugguaucgaaaugguccacgacggcgggaaggagacauggcauucugcugccacugcaauauauugccuuaugggaagcggccagcuguugugggauaccguuacagguguggacauggcccuauga

SEQ ID NO: 152347 - RNA, 1404 nt, Artificial Sequence; identical to SEQ ID NO: 152329
  derived and/or modified sequence opt3 from neuraminidase__InfluenzaB__AHZ36954

SEQ ID NO: 152348 - RNA, 1401 nt, Artificial Sequence
  derived and/or modified sequence opt3 from neuraminidase__InfluenzaB__AHZ36965
augcugcccagcaccauccagacacucacucuuuuccugacguccggcgggguguuguuaucucuguacgucucagccagucuaagcuaucuccuguacuccgacauucuucugaaguuuucuccuccagagauaaacgcuccgaccaugcccuuggauugcgcaaaugccucgaacguucaagcggugaauagaucagcuacaaaaggaguaacucuccugcugccugaaccagaguggaccuaucccaggcucagcuguccugguaguacauuccagaaggccuuacugaucuccccacaccgguuuggcgaaaccaaagggaacucugcaccccuuauuauccgcgagccuuucauugccugcggaccaaaugaauguaagcauuuugcuuugacucacuacgcagcccagccgggcgguuauuacaacgggacacgaggagaccguaauaaacugagacaucuaaucagcgugaagcucggcaagauacccaccgucgagaacuccaucuuccacauggcugccuggucaggcagugcgugccaugaugggaaagaguggacguauauuggaguggacgguccugauaauaacgcacugcuuaagguuaaauacggcgaagccuacacugacaccuaucacagcuacgcuaauaagauccugaggacacaggagucugccuguaacugcauugggggaaauuguuauuugaugaucacugauggcuccgcaucaggugugagcgaaugccgguuucucaaaauacgcgaggggagaauuaucaaggagauuuucccaaccggaagggucaagcacacagaagaguguaccugcggcuuugcuaguaacaaaacgaucgaaugugccugccgggacaaucgcuacacugcgaagcgacccuucgugaaacugaacguagagacagauaccgccgaaaucagauuaaugugcacugacacauaucuggauaccccuaggccaaacgacggcucuauuacggggcccugugaguccgauggagacaaggguagcggcgggauaaaaggaggcuuuguucaucaacggaugaagucgaaaaucggucguugguacucucgcaccauguccaagacagagagaauggggaugggccucuaugugaaguacgacggagauccgugggcagacucagaugcucuugccuucaguggcgucauggugagcaugaaagaaccugggugguacuccuuuggauucgagauuaaggacaaaaagugcgaugugcccuguaucgguauagaaaugguccacgacggcgggaaagagacuuggcauucugcugccaccgcaauuuauugccugaugggaagcggccaguugcuaugggauacaguuacugguguggacauggcccuguga

SEQ ID NO: 152349 - RNA, 1404 nt, Artificial Sequence; identical to SEQ ID NO: 152329
  derived and/or modified sequence opt3 from neuraminidase__InfluenzaB__AHZ36976

SEQ ID NO: 152350 - RNA, 1404 nt, Artificial Sequence; identical to SEQ ID NO: 152329
  derived and/or modified sequence opt3 from neuraminidase__InfluenzaB__AHZ36987

SEQ ID NO: 152351 - RNA, 1401 nt, Artificial Sequence; identical to SEQ ID NO: 152332
  derived and/or modified sequence opt3 from neuraminidase__InfluenzaB__AHZ36998

SEQ ID NO: 152352 - RNA, 1401 nt, Artificial Sequence
  derived and/or modified sequence opt3 from neuraminidase__InfluenzaB__AHZ37009
augcugcccagcaccauccagacacucacucuuuuccugacguugggcgggguguuacugucccuauacgucucugccucacucaguuaucugcuuuacagcgacauucuguugaaguuuuccccuaccgagauaacagcuccaacuaugccgcucggaugcgcaaacgccucuaauguucaagcggugaacagaucggcuaccaaagguguaacacugcugcuccccgaaccugaguggaccuauccaagguuaucaugucccggcagcacuuuccagaaggcccugcuuaucaguccucaccgguuuggggaaacaaaaggaaauuccgcaccauugauuauccgcgagcccuucauugccugcggcccuaacgaauguaagcauuuugcucugacccacuacgcagcccagccagguggguauuacaauggaacgcgaggcgaucguaacaaacuaagacaucucaucucugugaagcugggcaagauaccgacugucgagaauagcaucuuccacauggcugccugguccgggucagcgugccaugacggaaaagaguggaccuauauugguguggauggccccgacaacaaugcacuucugaagguuaaauacggggaagccuacacagauacuuaucacaguuacgcuaacaagaucuugaggacccaggagagcgccuguaauugcauuggaggcaacuguuaucucaugaucacagacgguucugcauccggggugucagaaugccgguuucugaaaauacgcgagggaagaauuaucaaggagauuuucccuaccggcagggucaagcacacggaagaguguacuugcggcuuugcuagcaauaaaacaaucgaaugugccugccgggauaaccgcuacaccgcgaagcgaccauucgugaaauuaaauguagaggccgacacugcagaaaucagacugaugugcacagauaccuaucucgacacgcccaggccuaacgaugggaguauuaccggaccaugugagucugacggugauaagggcuccgggggaauaaaaggcgguuuuguucaucaacggaugaaaagcaagaucgggcguugguacucgcgcacaaugucuaagacugagagaaugggcaugggacuuuaugugaaguacgacggcgaccccugggcugauuccgacgcccuggcuuucucaggggucauggugaguaugaaagaaccgggaugguacagcuuugguuucgagauuaaggauaaaaagugcgacgugccuuguaucggcauagaaaugguccacgaugggggaaaagagaccuggcauuccgccgcaacagccauuuauugcuugaugggcucuggucagcuacugugggacacuguuaccgggguggauauggcucucuga

SEQ ID NO: 152353 - RNA, 1401 nt, Artificial Sequence; identical to SEQ ID NO: 152330
  derived and/or modified sequence opt3 from neuraminidase__InfluenzaB__AHZ37020

SEQ ID NO: 152354 - RNA, 1401 nt, Artificial Sequence; identical to SEQ ID NO: 152332
  derived and/or modified sequence opt3 from neuraminidase__InfluenzaB__AHZ37031

SEQ ID NO: 152355 - RNA, 1401 nt, Artificial Sequence; identical to SEQ ID NO: 152330
  derived and/or modified sequence opt3 from neuraminidase__InfluenzaB__AHZ37042

SEQ ID NO: 152356 - RNA, 1401 nt, Artificial Sequence; identical to SEQ ID NO: 152332
  derived and/or modified sequence opt3 from neuraminidase__InfluenzaB__AHZ37064

SEQ ID NO: 152357 - RNA, 1401 nt, Artificial Sequence; identical to SEQ ID NO: 152330
  derived and/or modified sequence opt3 from neuraminidase__InfluenzaB__AHZ37075

SEQ ID NO: 152358 - RNA, 1401 nt, Artificial Sequence; identical to SEQ ID NO: 152330
  derived and/or modified sequence opt3 from neuraminidase__InfluenzaB__AHZ37086

SEQ ID NO: 152359 - RNA, 1401 nt, Artificial Sequence
  derived and/or modified sequence opt3 from neuraminidase__InfluenzaB__AHZ37097
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcccccugaaccagaguggaccuaucccaggcugagcuguccugguaguacuuuccagaaggcccucuuaaucuccccacaccgguuuggcgaaacaaaaggaaauucugcaccccugauuauccgcgagccuuucauugccugcgggccaaacgaauguaagcauuuugcucuuacccacuacgcagcccagccgggcgguuauuacaaugggacgcgaggagaccguaacaaauugagacaucugaucagcgugaagcuaggcaagauacccacugucgaaaauuccaucuuccacauggcugccuggucaggcagugcgugccaugaugggaaagaguggaccuauauuggaguggacgguccugauaacaaugcacuccugaagguuaaauacggcgaggccuacacagacacuuaucacagcuacgcuaacaagauccuuaggacccaggagucugccuguaauugcauugggggaaacuguuaucugaugaucacagauggcuccgcaucaggugugagcgaaugccgguuuuugaaaauacgcgaggggagaauuaucaaggagauuuucccaaccggaagggucaagcacacggaagaguguacuugcggcuuugcuaguaauaaaacaaucgaaugugccugccgggacaaccgcuacaccgcgaagcgacccuucgugaaacucaauguagagacugauacagccgaaaucagacugaugugcaccgacacguauuuagauaccccuaggccaaacgacggcucuauuacagggcccugugaguccgauggagacaaggguagcggcgggauaaaaggaggcuuuguucaucaacggaugaagucgaaaaucggucguugguacucucgcacuauguccaagaccgagagaauggggaugggccuguaugugaaguacgacggagauccgugggcagacucagaugcucucgccuucaguggcgucauggugagcaugaaagaaccugggugguacuccuuuggauucgagaugaaggacaaaaagugcgaugugcccuguauugguaucgaaaugguccacgacggcgggaaagagacauggcauucugcugccacugcaauauauugccuuaugggaagcggccagcuguugugggauaccguuacagguguggacauggcccuauga

SEQ ID NO: 152360 - RNA, 1401 nt, Artificial Sequence; identical to SEQ ID NO: 152330
  derived and/or modified sequence opt3 from neuraminidase__InfluenzaB__AHZ37108

SEQ ID NO: 152361 - RNA, 1401 nt, Artificial Sequence
  derived and/or modified sequence opt3 from neuraminidase__InfluenzaB__AHZ41774
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggagcaacgaaugucgacacuucgcucuuacacauuacgcagcccagccuggcgguuauuacaaugggacccguggagacagaaacaaguugaggcaccugaucuccgugaaacuaggcaagauaccaacggucgaaaauucaaucuuucauauggcugccuggaguggcagcgcgugccacgaugggaaggaguggacuuauauuggaguggacgguccggauaacaaugcacuccugaaaaucaaguacggcgaggccuacaccgacacauaucacucuuacgcuaacaauauucuucggacucaggaguccgccuguaacugcaucgggggaaauuguuaucugaugauaaccgauggcucagcaagcgguguuagugaaugccgcuucuugaaaauuagagaggggaggaucauuaaggagaucuuucccacaggacgggugaaacauaccgaagaguguacgugcggcuucgcuucuaacaagacuaucgaaugugccugccgcgacaauuccuacacagcgaagcgaccuuuugucaaacucaacguggagaccgauacugccgaaauuagacugaugugcacagacaccuauuuagauacgccaaggcccgacgauggcagcauaaccgggccuugugagucgaacggagacaaggguucuggcgggaucaaaggaggcuucguacaccagcggauggcauccaagauuggucguugguacucacgcacaaugaguaaaacugagagaaaggggaugggccuguauguuaaauacgacggagauccauggaccgacaaugaugcucucgccuuuaggggcgugauggucagcaugaaggaacccgggugguacuccuucggauucgagaucaaggacaaaaagugcgaugugccguguauagguauugaaauggugcaugacggcgggaaagagacauggcacucugcugccacugcaaucuauugccuuaugggaagcggccaacuguugugggauaccgucacagguguugacauggcccuauga

SEQ ID NO: 152362 - RNA, 1401 nt, Artificial Sequence; identical to SEQ ID NO: 150972
  derived and/or modified sequence opt3 from neuraminidase__InfluenzaB__AHZ41785

SEQ ID NO: 152363 - RNA, 1401 nt, Artificial Sequence; identical to SEQ ID NO: 150972
  derived and/or modified sequence opt3 from neuraminidase__InfluenzaB__AHZ41796

SEQ ID NO: 152364 - RNA, 1401 nt, Artificial Sequence
  derived and/or modified sequence opt3 from neuraminidase__InfluenzaB__AHZ41807
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaauguaagcacuucgcucuuacacauuacgcagcccagccaggcgguuauuacaaugggacccgaggagaccguaacaaauugagacaccugaucagcgugaagcuaggcaagauaccgacggucgaaaauuccaucuuucauauggcugccuggucaggcagugcgugccacgaugggaaagaguggacuuauauuggaguggacggucccgauaacaaugcacuccugaagaucaaauacggcgaggccuacaccgacacauaucacagcuacgcuaacaauauucuuaggacucaggagucugccuguaacugcaucgaagggaauuguuaucugaugauaaccgauggauccgcaucaggcguuagcgagugccgguucuugaagauucgcgaggguagaaucauuaaagaaaucuuuccuacagggagggugaagcauaccgaggaauguacgugcggauucgcuaguaacaagacuaucgagugugccugccgggacaauucuuacacagcgaaacgcccauuugucaagcucaacguggaaaccgauacugccgagauucgacugaugugcacagacaccuauuuagauacgcccagaccugacgauggcuccauaaccggcccaugugagagcaacggggacaaaggaucggguggcaucaaagggggauucguacaccagaggauggcaucuaagauuggccggugguacucccguacaaugucaaagacugaacgcaaagguauggggcuguauguuaaguacgacggcgaucccuggaccgacagugaugcucucgccuuuagaggagugauggucagcaugaaggagccgggcugguacuccuucggguucgaaaucaaagacaagaaaugcgaugugccuuguauaggaauugagauggugcaugacgguggcaaggaaacauggcacucugcugccacugcaaucuauugccuuauggggagcggacaacuguugugggauaccgucacaggcguugacauggcccuauga

SEQ ID NO: 152365 - RNA, 1401 nt, Artificial Sequence
  derived and/or modified sequence opt3 from neuraminidase__InfluenzaB__AHZ41818
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugauggugacagauggcuccgcaucaggugucagcgaaugccgguuucucaaaauccgcgaggggagaauaauuaaggagaucuucccuaccggaagggugaagcacacggaagaguguacuugcggcuuugcuaguaauaaaacaauugaaugugccugccgggacaacucuuacaccgcgaagcgcccauucguaaaacugaauguugagacugauacagccgaaauccgauuaaugugcaccgacacguaucuggauacccccagaccugacgauggcuccaucacagggccaugugagagcaacggagacaaggguucgggcgggauuaaaggaggcuuugugcaucaaaggauggagucuaagauaggucggugguacucccguacuaugucaaaaaccgaacgcauggggaugggccucuaugucaaguacgacggagaucccugggcagacagugaugcucuuguguucagcggcgugauggucuccaugaaggagccggggugguacucuuuuggauucgaaaucaaagacaagaaaugcgauguuccuuguauugguaucgagauggugcacgacggcgggaaggaaacauggcauagcgccgcuacugccauauauugccugaugggaucaggccaguugcuaugggauaccguaacaggugugaacauggcacuguga

SEQ ID NO: 152366 - RNA, 1401 nt, Artificial Sequence; identical to SEQ ID NO: 150972
  derived and/or modified sequence opt3 from neuraminidase__InfluenzaB__AHZ41829

SEQ ID NO: 152367 - RNA, 1401 nt, Artificial Sequence
  derived and/or modified sequence opt3 from neuraminidase__InfluenzaB__AHZ41840
augcugcccagcaccauccagaugcucacacuuuuccugacuuccggcgggguguuguuaucucuguacgucucagccagucuaagcuaucuccuguacuccgacauucuucugaaguuuucuccuacggagauaaccgcuccaacaaugccguuggauugcgcaaacgccucgaauguucacgcggugaacagaucagcuacuaaaggaguaaccuuccuccugcccgaaccugaguggacauauccaaggcugagcugucccgguaguaccuuucaaaaggcccucuuaaucuccccucaucgguucggcgaaacuaaaggaaauucugcaccacugauuauccgcgagcccuuuauugccugcgggccuaacgaaugucgacacuucgcucuuacacauuacgcagcccagccaggcgguuauuacaaugggacccguggagacagaaacaaguugaggcaccugaucagcgugaaacuaggcaagauaccgacggucgaaaauuccaucuuucauauggcugccuggucaggcagugcgugccacgaugggaaggaguggacuuauauuggaguggacggucccgauaacaaugcacuccugaaaaucaaguacggcgaggccuacaccgacacauaucacagcuacgcuaacaauauucuucggacucaggagucugccuguaacugcaucgggggaaauuguuaucugaugauaaccgauggcuccgcaucagguguuagcgaaugccgcuucuugaaaauuagagaggggaggaucauuaaggagaucuuuccuacaggacgggugaaacauaccgaagaguguacgugcggcuucgcuaguaacaagacuaucgaaugugccugccgcgacaauucuuacacagcgaagcgaccauuugucaaacucaacguggagaccgauacugccgaaauuagacugaugugcacagacaccuauuuagauacgcccaggccugacgauggcuccauaaccgggccaugugagagcaacggagacaaggguucgggcgggaucaaaggaggcuucguacaccagcggauggcaucuaagauuggucguugguacucccgcacaaugucaaaaacugagagaaaggggaugggccuguauguuaaauacgacggagaucccuggaccgacagugaugcucucgccuuuaggggcgugauggucagcaugaaggaaccggggugguacuccuucggauucgagaucaaggacaaaaagugcgaugugccuuguauagguauugaaauggugcaugacggcgggaaagagacauggcacucugcugccacugcaaucuauugccuuaugggaagcggccaacuguugugggauaccgucacagguguugacauggcccuauga

SEQ ID NO: 152368 - RNA, 1401 nt, Artificial Sequence; identical to SEQ ID NO: 150972
  derived and/or modified sequence opt3 from neuraminidase__InfluenzaB__AHZ41851

SEQ ID NO: 152369 - RNA, 1401 nt, Artificial Sequence; identical to SEQ ID NO: 152218
  derived and/or modified sequence opt3 from neuraminidase__InfluenzaB__AHZ41862

SEQ ID NO: 152370 - RNA, 1401 nt, Artificial Sequence
  derived and/or modified sequence opt3 from neuraminidase__InfluenzaB__AHZ41873
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaaugcgcaagcuguuaacagaucagccaccaaaggagugacacuccugcugcccgaaccugaguggaccuauccaaggcucagcugucccgguaguacuuuccagaaggcauuacugaucuccccucaccgguuuggcgaaacaaaaggaaauucugccccacuuauuauccgcgagcccuucauugcuugcgggccuaacgaauguaagcauuuugcauugacccacuacgccgcucagccaggcgguuauuacaaugggacgcgaggagaccguaacaaacugagacaucuaaucagcguaaagcucggcaagauaccgacuguggaaaauuccaucuuccacauggccgcguggucaggcagugcaugccaugaugggaaagaguggaccuauauuggagucgacggucccgauaacaaugcccugcuuaaggugaaauacggcgaggcuuacacagacacuuaucacagcuacgccaacaagauccugaggacccaggagucugcauguaauugcauugggggaaacuguuauuugaugaucacagauggcuccgcuucagguguuagcgaaugccgguuucucaaaauacgcgaggggagaauuaucaaggagauuuucccuaccggaagggugaagcacacggaagaguguacuugcggcuuugccaguaauaaaacaaucgaaugugcgugccgggacaaccgcuacaccgccaagcgaccauucgucaaacugaauguggagacugauacagcagaaaucagauuaaugugcaccgacacguaucuggauacccccaggccuaacgacggcucuauuacagggccaugugaguccgauggagacaaggguagcggcgggauaaaaggaggcuuuguacaucaacggaugaagucgaaaaucggucguugguacucucgcacuauguccaagaccgagagaauggggaugggccucuauguuaaguacgacggagaucccugggcugacucagaugcccuuacauucaguggcgugauggucagcaugaaagaaccggggugguacuccuuuggauucgagauuaaggacaaaaagugcgaugugccuuguaucgguauagaaauggugcacgacggcgggaaagagacuuggcauucugcugccaccgcaauuuauugccugaugggaagcggccaguugcuaugggauacagucaccgguguugacauggcccuguga

SEQ ID NO: 152371 - RNA, 1401 nt, Artificial Sequence; identical to SEQ ID NO: 150808
  derived and/or modified sequence opt3 from neuraminidase__InfluenzaB__AIL94981

SEQ ID NO: 152372 - RNA, 1401 nt, Artificial Sequence; identical to SEQ ID NO: 150808
  derived and/or modified sequence opt3 from neuraminidase__InfluenzaB__AIL94992

SEQ ID NO: 152373 - RNA, 1401 nt, Artificial Sequence; identical to SEQ ID NO: 150833
  derived and/or modified sequence opt3 from neuraminidase__InfluenzaB__AIL95003

SEQ ID NO: 152374 - RNA, 1401 nt, Artificial Sequence
  derived and/or modified sequence opt3 from neuraminidase__InfluenzaB__AIL95014
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaacagaucagcugccaaaggaguaacucuccugcugccggaacccgaguggaccuauccuaggcucagcuguccagguaguacauuccagaaggcauuacugauuucuccccaccgguuuggcgaaaccaaaggaaauuccgccccucuuaucauucgcgagccauucaucgcuugcgggcccacugaauguaagcauuuugcauugacacacuacgccgcucagccuggcgguuauuacaacgggacccgagaggaccguaauaaacugagacaucuaauaagcgugaagcucggaaagaucccaacggucgagaacuccauuuuccacauggccgcguggucaggcagugcaugccaugauggcaaagaauggacuuauaucgggguggacggaccggauagcaaugcccugcuuaagauuaaauacggugaggcuuacaccgacacauaucacucuuacgccaagaacauccugaggacucaagaauccgcauguaauugcauaggcggggauuguuauuugaugauuaccgacggacccgcuucaggcguuagcgagugccgguuucucaaaauccgcgaggguagaauuaucaaggaaaucuucccuacagggagggugaagcacaccgaggaauguacgugcggauuugccaguaacaaaacuauugagugugcgugccgggauaauucuuacacagccaagcgcccauucgucaaacugaacguggaaaccgacacugcagagauacgauuaaugugcacagagaccuaucuggauacgcccagaccuaaugacggcuccaucaccggcccaugugaaagcgauggggacaagggaucggguggcauuaaagggggauuuguacaucagaggauggcuucuaagaucggccggugguacucccguacaaugucaaaaacuaagcgcauggguauggggcucuauguuaaguacgacggcgaucccuggaccgacagugaggcccuugcucugagcggagugauggucuccauggaggaaccgggcugguacucuuucggguuugaaauaaaagauaagaaaugcgacgugccuuguauuggaaucgagauggugcacgaugguggcaagacaacuuggcauagcgccgcaaccgccaucuauugcuugauggggucaggacagcuacugugggacacagucaccggcguugauaugacucucuga

SEQ ID NO: 152375 - RNA, 1401 nt, Artificial Sequence; identical to SEQ ID NO: 150833
  derived and/or modified sequence opt3 from neuraminidase__InfluenzaB__AIL95025

SEQ ID NO: 152376 - RNA, 1401 nt, Artificial Sequence
  derived and/or modified sequence opt3 from neuraminidase__InfluenzaB__AIL95036
augcugagcuccaccauccagacacucacucuuuuccugacgucuggcgggguguuguuaucacuguacgucagugccagccuauccuaucuccuguacucugacauucuucugaaguuuucgcccaaagagauaaccgcuccuacaaugccauuggauugcgcaaacgccucaaauguucaagcggugaaccacagcgcuacuaagggaguaacccuccugcugccggaacccgaguggacauauccuagacucaguuguccagguuccaccuuccagaaagccuuacugaucucuccccauagguuuggcgaaacuaaggggaauagcgcaccucuuauuauccgggagccauucauugccugcggacccaacgaauguaaacacuuugcuuugacacauuacgcagcccagccuggcgguuauuacaaugggacccgcggagaccgaaacaagcugcgucaccuaaucuccgugaagcucggcaaaauaccaacggucgaaaauucaaucuuccauauggcugccuggaguggcagcgcgugccacgaugggaaggaguggacuuauauuggaguggacgguccggauaacaaugcacugcuuaaaguuaaguacggcgaggccuacaccgacacauaucacucuuacgcuaacaaaauccugagaacucaggaguccgccuguaauugcauugggggaaacuguuauuugaugaucaccgauggcucagcaagcggugugagugaaugcagguuucucaagauacgggaggggcgcauuaucaaggagauuuuccccacaggaagagucaaacauaccgaagaguguacgugcggcuuugcuucuaauaagacuaucgaaugugccugcagggacaacuccuacacagcgaaacggccuuucgugaagcugaauguagagaccgauacugccgaaauccgcuuaaugugcacagacaccuaucuggauacgccacgacccgacgauggcagcauuaccgggccuugugagucgaacggagacaaagguucuggcgggauaaagggaggcuuuguucaccaaagaauggaguccaaaaucgguaggugguacucacggacaaugaguaagacugaacguauggggaugggccucuaugugaaguacgacggagauccaugggcagacagcgaugcucuugccuucuccggcgucauggugucuaugaaagagcccgggugguacagcuuuggauucgaaauuaaggacaaaaagugcgaugugccguguaucgguauagagaugguccaugacggcgggaaagaaaccuggcacucagcugccacagcaauuuauugccugaugggaaguggccaguugcuaugggauacuguuaccgguguggacauggcccuguga

SEQ ID NO: 152377 - RNA, 1401 nt, Artificial Sequence; identical to SEQ ID NO: 150833
  derived and/or modified sequence opt3 from neuraminidase__InfluenzaB__AIL95047

SEQ ID NO: 152378 - RNA, 1401 nt, Artificial Sequence; identical to SEQ ID NO: 150942
  derived and/or modified sequence opt3 from neuraminidase__InfluenzaB__AIL95058

SEQ ID NO: 152379 - RNA, 1401 nt, Artificial Sequence; identical to SEQ ID NO: 150891
  derived and/or modified sequence opt3 from neuraminidase__InfluenzaB__AIL95069

SEQ ID NO: 152380 - RNA, 1401 nt, Artificial Sequence
  derived and/or modified sequence opt3 from neuraminidase__InfluenzaB__AIL95080
augcugcccagcaccauccagacacucacucuuuuccugacguccggcgggguguuguuaucucuguacgucucagccagucuaagcuaucuccuguacuccgacauucuucugaaguuuucuccuaaagagauaaccgcuccaacaaugccguuggauugcgcaaacgccucgaauguucaagcggugaaccacucagcuacuaagggaguaacccuccugcugcccgaaccugaguggacauauccaagacucagcugucccgguaguaccuuccagaaagccuuacugaucuccccucauagguuuggcgaaacuaagggaaauucugcaccacuuauuauccgggagcccuucauugccugcgggccuaacgaauguaaacacuuugcuuugacacauuacgcagcccagccaggcgguuauuacaaugggacccgcggagaccgaaacaagcugcgucaccuaaucagcgugaagcucggcaaaauaccgacggucgaaaauuccaucuuccauauggcugccuggucaggcagugcgugcaacgaugggaaggaguggacuuauauuggaguggacggucccgauaauaacgcacugcuuaaaguuaaguacggcgaggccuacaccgacacauaucacagcuacgcuaauaaaauccugagaacucaggagucugccuguaacugcauugggggaaauuguuauuugaugaucaccgauggcuccgcaucaggugugagcgaaugcagguuucucaagauacgggaggggcgcauuaucaaggagauuuucccuacaggaagagucaaacacaccgaagaguguacgugcggcuuugcuaguaacaagacuaucgaaugugccugcagggacaauucuuacacagcgaaacggccauucgugaagcugaacguagagaccgauacugccgaaauccgcuuaaugugcacagacaccuaucuggauacgccccgaccugacgauggcuccauuaccgggccaugugagagcaacggagacaaagguucgggcgggauaaagggaggcuuuguucaucaaagaauggagucuaaaaucgguaggugguacucccggacaaugucaaagacugaacguauggggaugggccucuaugugaaguacgacggagaucccugggcagacagugaugcucuugccuucagcggcgucaugguguccaugaaagagccggggugguacucuuuuggauucgaaauuaaggacaaaaagugcgaugugccuuguaucgguauagagaugguccacgacggcgggaaagaaaccuggcauagcgcugccacagcaauuuauugccugaugggaucaggccaguugcuaugggauacuguuaccgguguggacauggcccuguga

SEQ ID NO: 152381 - RNA, 1401 nt, Artificial Sequence; identical to SEQ ID NO: 150891
  derived and/or modified sequence opt3 from neuraminidase__InfluenzaB__AIL95091

SEQ ID NO: 152382 - RNA, 1401 nt, Artificial Sequence; identical to SEQ ID NO: 150833
  derived and/or modified sequence opt3 from neuraminidase__InfluenzaB__AIL95102

SEQ ID NO: 152383 - RNA, 1401 nt, Artificial Sequence
  derived and/or modified sequence opt3 from neuraminidase__InfluenzaB__AIL95113
augcugcccagcaccauccagacacucacucuuuuccugacguccggcgggguguuguuaucucuguacgucucagccagucuaagcuaucuccuguacuccgacauucuucugaaguuuucuccuaccggaauaacagcuccaacuaugccguuggauugcgcaaacgccucgaauguucaagcggugaacagaucagcuaccaaagguguaacacuccugcccccugagccagaauggaccuaucccaggcugagcuguccuggcaguacuuuccagaaggcccucuuaaucuccccacaccgguuuggggagacaaaaggaaauucugcaccccugauuauccgcgaaccuuucauugccugcggcccaaacgaguguaagcauuuugcucuuacccacuacgcagcccagccggguggguauuacaauggaacgcgaggcgaccguaacaaauugagacaucugaucagcgugaagcuaggcaagauacccacugucgaaaauuccaucuuccacauggcugccuggucagggagugcgugccaugauggaaaagaguggaccuauauugguguggacggcccugauaacaaugcacuccugaagguuaaauacggggaggccuacacagacacuuaucacagcuacgcuaacaagauccuuaggacccaggaaucugccuguaauugcauuggaggcaacuguuaucugaugaucacagaugguuccgcaucaggggugagcgagugccgguuuuugaaaauacgcgaaggaagaauuaucaaggagauuuucccaaccggcagggucaagcacacggaggaauguacuugcggcuuugcuaguaauaaaacaaucgagugugccugccgggacaaccgcuacaccgcgaagcgacccuucgugaaacucaauguagaaacugauacagccgagaucagacugaugugcaccgacacguauuuagauaccccuaggccaaacgacgggucuauuacaggacccugugaauccgauggugacaagggcagcgggggaauaaaaggcgguuuuguucaucaacggaugaagucgaaaaucgggcguugguacucucgcacuauguccaagaccgagagaaugggcaugggacuguaugugaaguacgacggcgauccgugggcagacucagaugcucucgccuucaguggggucauggugagcaugaaagagccuggaugguacuccuuugguuucgaaaugaaggacaaaaagugcgaugugcccuguauuggcaucgagaugguccacgacgggggaaaagaaacauggcauucugcugccacugcaauauauugccuuaugggcagcggucagcuguugugggauaccguuacagggguggacauggcccuauga

SEQ ID NO: 152384 - RNA, 1401 nt, Artificial Sequence; identical to SEQ ID NO: 152330
  derived and/or modified sequence opt3 from neuraminidase__InfluenzaB__AIL95124

SEQ ID NO: 152385 - RNA, 1401 nt, Artificial Sequence
  derived and/or modified sequence opt3 from neuraminidase__InfluenzaB__AKA54777
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagacaggccgcugguacuccagaacuaugucaaaaaccaagaggauggguauggggcuguauguuaaguacgacggcgauccguggacagacagugaggcucucgcccuuagcggagugauggucuccauggaggaaccuggcugguacucuuucggguuugaaaucaaagauaagaaaugcgacgugcccuguauaggaauugagauggugcacgaugguggcaagacuaccuggcauagcgcugccacagcaaucuauugccugauggggucaggacaguugcuaugggacaccgucacuggcguuaacaugacgcuguga

SEQ ID NO: 152386 - RNA, 1401 nt, Artificial Sequence
  derived and/or modified sequence opt3 from neuraminidase__InfluenzaB__AKA54781
augcugcccagcaccauccagacacucacucuuuuccugacguccggcgggguguuguuaucucuguacgucucagccagucuaagcuaucuccuguaccuugacauucuguugaaguuuccuuccaccgagauaacagcuccaacuaugccgcucgauugcgcaaacgccucuaauguucaagcggugaacagaucggcuaccaaaggaguaacauuccugcugcccgaaccugaguggaccuauccaaggcucucaugucccgguagcacuuuucagaaggccuuacugaucaguccucaccgguucggcgaaacaaaaggaaauuccgcaccacuuauuauccgcgagcccuuuauugccugcgggccuaaggaauguaaacauuucgcuuugacccacuacgcagcccagccaggcgguuauuacaacgggacgcgaggagaccguaauaagcugagacaucuaaucucugugaagcucggcaaaauaccgacugucgagaacagcaucuuucacauggcugccugguccggcucagcgugccaugaugggaaggaguggaccuauauuggaguggacggucccgauaauaacgcacugcuuaaaaucaaguacggcgaagccuacacagacacuuaucacaguuacgcuaauaacauucugaggacccaggagagcgccuguaauugcaucgggggaaacuguuauuugaugauaacagauggcucugcauccgguguuucagaaugccgguuccucaaaauucgcgaggggagaaucaugaaggagauuuuuccuaccggaaggacgcaacacacugaagaguguacaugcggcuucgcuagcaauaagaccaucgaaugugugugccgggacaacaguuacacugccaaacgcccauuugucaagcugaauguggagacagauaccgcggaaauccgauuaaugugcacgaaaaccuaucuggacacacccagaccugaugacggcucuauuacugggccaugugaguccaacggagguaagggcagcgggggaauaaaaggcgguuucguacaucagaggauggccucgaagaucgggcggugguacucucguaccauguccaaaacagagcgcaagggcaugggacucuauguuaaguacaacggcgaucccugggcagacucagacgcucuuacuuuuaguggggugauggucagcauggaggaaccgggaugguacuccuucgguuucgaaauuaaagauaagaaaugcgacgugccuuguaucggcauagagauggugcacgaugggggaaaggaaaccuggcauucugccgcuacagccauuuauugccugaugggcagcggucaguugcuaugggacaccgucacugggguuaauaugacgcuguga

SEQ ID NO: 152387 - RNA, 1401 nt, Artificial Sequence
  derived and/or modified sequence opt3 from neuraminidase__InfluenzaB__AKA54783
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuuuuccccgaaccugaguggacauauccacggcugagcugucccgguaguaccuuucagaaggcccugcucaucuccccucaccgcuucggcgaaacuaaaggaaauucugcaccauuaauuauccgagagcccuuuauugccugcgggccuaaggaauguaaacauuucgcucugacacacuacgcagcccagccaggcgguuauuacaacgggacccgugaggacagaaauaagcucaggcauuugaucagcgucaagcugggaaaaauaccgacgguggagaacuccaucuuucacauggcugccuggucaggcagugcgugccaugauggccgggaauggacuuauauugggguugacggacccgauagcaaugcacuacucaagaucaaauacggugaggccuacaccgacacauaucacucuuacgcuaagaacauucugcgcacucaggaauccgccuguaauugcaucggcggggauuguuaucuuaugauaaccgacggaccugcaucaggcauuagcgagugcagauuccugaaaaucagggagggucggauuaucaaggaaaucuuuccaacagggcgcgugaagcacaccgaggaauguacgugcggauucgcuaguaacaaaacuauugagugugccugccgagauaauucuuacacagcgaagagacccuuugucaaauugaacguggaaaccgacacugccgagauaaggcucaugugcacaaagaccuaucuggauacgccucggccaaaugacggcuccaucaccggccccugugagagcgauggggacgaaggaucggguggcauuaaagggggauucguacaucaacguauggcaucuaagaucggccgcugguacuccagaacaaugucaaaaacuaagaggauggguaugggguuauauguuaaguacgacggcgauccguggaccgacagugaggcucuggcccucagcggagugauggucuccauggaggaaccuggcugguacucuuuuggguucgaaauaaaagauaagaaaugcgacgugcccuguauuggaaucgagauggugcacgaugguggcaagacaacuuggcauagcgcugccaccgcaaucuauugccuuauggggucaggacagcuguugugggacacagucaccggcguuaacaugacucuauga

SEQ ID NO: 152388 - RNA, 1401 nt, Artificial Sequence
  derived and/or modified sequence opt3 from neuraminidase__InfluenzaB__AKA54785
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgaugggaacgaaggaucggguggcauuaaagggggauuuguacaucaacguauggcaucuaagaucggccgcugguacuccagaacaaugucaaaaacuaagaggauggguauggggcuguauguuaaguacgacggcgacccguggaccgauagugaggcucucgcccuuagcggagugauggucuccauggaggaaccuggcugguacucuuucggguuugaaauaaaagacaagaaaugcgaugugcccuguauuggaaucgagauggugcacgacgguggcaagacaacuuggcauagcgcugccaccgcaaucuauugccugauggggucaggacaguugcuaugggauacagucaccggcguuaauaugacucuguga

SEQ ID NO: 152389 - RNA, 1401 nt, Artificial Sequence
  derived and/or modified sequence opt3 from neuraminidase__InfluenzaB__AKA54787
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcugccaaaggaguaacucuccugcugccggaacccgaguggaccuauccuagacucagcuguccagguaguacauuccagaaggcauuacugauuucuccccauagguuuggcgaaaucaaaggaaauuccgccccucuuauuauccgggagccauucauagcuugcgggcccaccgaauguaagcacuuugcauugacucauuacgccgcucagccuggcgguuauuacaacgggacacgcgaggaccgaaauaaacugcgucaccuaaucagcgugaagcucggaaagauuccaaccgucgagaacuccaucuuccauauggccgcguggucaggcagugcaugccacgauggcaaagaauggacguauauugggguggacggaccggauagcaaugcccugcuuaagaucaaauacggugaggcuuacacugacaccuaucacucuuacgccaagaacauacugagaacacaagaauccgcauguaauugcauuggcggggauuguuauuugaugaucacugacggacccgcuucaggcguuagcgagugcagguuucucaaaauucgggagggucgcaucaucaaggaaauuuucccuaccgggagagugaagcauacagaggaauguaccugcggauuugccaguaacaaaacgauagagugugcgugcagggauaaucgguacacugccaagcgcccauucgucaaacugaacguggaaacagacaccgcagagauccgauuaaugugcacugagacauaucuggauacccccagaccuaaugacggcucuauuacgggcccaugugaauccgauggggacaagggaagcgguggcaucaaagggggauuuguacaccagaggauggcuucgaagauaggccggugguacucucguaccauguccaaaacaaagcgcauggguauggggcucuauguuaaguacgacggcgaucccuggacugacucagaggcccuugcucugaguggagugauggucagcauggaggaaccgggcugguacuccuucggguuugaaauuaaagauaagaaaugcgacgugccuuguaucggaaucgagauggugcaugaugguggcaagaccacauggcacucugccgcaacugccauuuauugcuugauggggagcggacagcuacugugggacaccgucacaggcguugauauggcucucuga

SEQ ID NO: 152390 - RNA, 1401 nt, Artificial Sequence
  derived and/or modified sequence opt3 from neuraminidase__InfluenzaB__AKA54789
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucuccauggaggaaccuggcugguacucuuucggguuugaaauaaaagauaagaaaugcgacgugcccuguauuggaaucgagauggugcacgaugguggcaagacaacuuggcauagcgcugccaccgcaaucuauugccugauggggucaggacaguugcuaugggacacagucaccggcguuaacaugacucuguga

SEQ ID NO: 152391 - RNA, 1401 nt, Artificial Sequence
  derived and/or modified sequence opt3 from neuraminidase__InfluenzaB__AKA54791
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugcgcaagcugugaacaggucagccacuaaaggaguaaccccgcuccugcccgaaccugaguggacauauccacggcugagcugucccgguaguaccuuccagaaggcacucuuaaucuccccucaccgcuuuggcgaaacuaaaggaaauucugccccacugauuauccgagagcccuucauugcuugcgggccuaaggaauguaaacauuuugcacuuacacacuacgccgcucagccaggcgguuauuacaacgggacccgugaggacagaaauaaguugaggcaucugaucagcgugaagcuaggaaaaauaccgacggucgagaacuccaucuuccacauggccgcguggucaggcagugcaugccaugauggccgggaauggacuuauauugggguggacggacccgauagcaaugcccuccugaagaucaaauacggugaggcuuacaccgacacauaucacucuuacgccaagaacauucuucgcacucaggaauccgcauguaauugcaucggcggggauuguuaucugaugauaaccgacggaccugcuucaggcauuagcgagugcagauuuuugaaaaucagggagggucggauuaucaaggaaaucuucccaacagggcgcguuaagcacaccgaggaauguacgugcggauuugccaguaacaaaacuauugagugugcgugccgagauaauucuuacacagccaagagacccuucgugaaacucaacgucgaaaccgacacugcagagauaaggcugaugugcacaaagaccuauuuagauacgccucggccaaaugacggcuccaucaccggccccugugagagcgauggggacgaaggaucggguggcauuaaagggggauuugugcaucaacguauggcuucuaagaucggccgcugguacuccagaacaaugucaaaaacuaagaggauggguauggggcuguauguaaaguacgacggcgauccguggaccgacagugaggcccucgcucuuagcggaguuaugguguccauggaggaaccuggcugguacucuuucggguuugaaauaaaagauaagaaaugcgacguccccuguauuggaaucgagauggugcacgaugguggcaagacaacuuggcauagcgccgcaaccgccaucuauugccugauggggucaggacaguugcuaugggacacagugaccggcgucaacauuacucuguga

SEQ ID NO: 152392 - RNA, 1401 nt, Artificial Sequence; identical to SEQ ID NO: 152389
  derived and/or modified sequence opt3 from neuraminidase__InfluenzaB__AKA54793

SEQ ID NO: 152393 - RNA, 1401 nt, Artificial Sequence; identical to SEQ ID NO: 152389
  derived and/or modified sequence opt3 from neuraminidase__InfluenzaB__AKA54795

SEQ ID NO: 152394 - RNA, 1401 nt, Artificial Sequence; identical to SEQ ID NO: 152390
  derived and/or modified sequence opt3 from neuraminidase__InfluenzaB__AKA54797

SEQ ID NO: 152395 - RNA, 1401 nt, Artificial Sequence
  derived and/or modified sequence opt3 from neuraminidase__InfluenzaB__AKA54799
augcugcccagcaccauccagacacucacucuuuuccugacguccggcgggguguuguuaucucuguacgucucagccagucuaagcuaucuccuguacuccgacauucuucugaaguuuucucaaaccgagauaacagcuccuaucaugccauuggauugcgcaaacgccucgaauguucaggcggugaaccacucagcugccaaaggaguaacucuccugcugccggaacccgaguggaccuauccuagacucagcuguccagguaguacauuccagaaggcauuacugauuucuccccauagguuuggcgaaaucaaaggaaauuccgccccucuuauuauccgggagccauucauagcuugcgggcccaccgaauguaagcacuuugcauugacucauuacgccgcucagccuggcgguuauuacaacgggacacgcgaggaccgaaauaaacugcgucaccuaaucagcgugaagcucggaaagauuccaaccgucgagaacuccaucuuccauauggccgcguggucaggcagugcaugccacgauggcaaagaauggacguauauugggguggacggaccggauagcaaugcccugcuuaagaucaaauacggugaggcuuacacugacaccuaucacucuuacgaaaagaacauacugagaacacaagaguccgccuguaauugcauuggcggggauuguuauuugaugaucacugacggacccgcaucaggcguuagcgagugcagguuucucaaaauucgggaaggucgcaucaucaaggagauuuucccuaccgggagagugaagcauacagaagaguguaccugcggauuugcuaguaacaaaacgauagaaugugccugcagggauaaucgguacacugcgaagcgcccauucgucaaacugaacguggagacagacaccgccgagauccgauuaaugugcacugaaacauaucuggauacccccagaccuaaugacggcucuauuacgggcccaugugaguccgauggggacaagggaagcgguggcaucaaagggggauuuguacaccagaggauggcaucgaagauaggccggugguacucucguaccauguccaaaacaaagcgcauggguauggggcucuauguuaaguacgacggcgaucccuggacugacucagaagcucuugcccugaguggagugauggucagcauggaggaaccgggcugguacuccuucggguuugagauuaaagauaagaaaugcgacgugccuuguaucggaaucgagauggugcaugaugguggcaagaccacauggcacucugcugccacugcaauuuauugcuugauggggagcggacagcuacugugggacaccgucacaggcguugauauggcccucuga

SEQ ID NO: 152396 - RNA, 1401 nt, Artificial Sequence; identical to SEQ ID NO: 152390
  derived and/or modified sequence opt3 from neuraminidase__InfluenzaB__AKA54801

SEQ ID NO: 152397 - RNA, 1401 nt, Artificial Sequence
  derived and/or modified sequence opt3 from neuraminidase__InfluenzaB__AKA54803
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaauggagugaccccgcuccugcccgaaccugaguggacauauccacggcugagcugucccgguaguaccuuccagaaagcccucuuaaucuccccucaccgcuuuggcgaaacuaaggggaacucugcaccacugauuauccgagagcccuucauugccugcggaccuaaagaauguaagcauuuugcucuuacacacuacgcagcccagccaggcgguuauuacaaugggacccgugaggacagaaacaaauugaggcaucugaucagcgucaagcuaggaaagauaccgacgguggaaaauuccaucuuccacauggcugccuggucaggcagugcgugccaugauggccgggaauggacuuauauugggguugacggacccgauagcaacgcacuccugaaaaucaaguacggugaggccuacaccgacacauaucacucuuacgcuaaaaauauucuucgcacucaggaauccgccuguaacugcaucggcggggauuguuaucugaugauaaccgacggaccugcaucaggcauuagcgagugcagauuuuugaagaucagggagggucggauuaucaaagaaaucuucccaacagggcgcgugaagcacaccgaggaauguacgugcggauuugcuaguaauaagacuauugagugugccugccgagauaacucuuacacagcgaaaagacccuucgucaagcucaauguggaaaccgacacugccgagauaaggcugaugugcacaaaaaccuauuuagauacgccucggccaaacgacggcuccaucaccggccccugugagagcgauggggacgaaggaucggguggcauuaaagggggauuuguacaucaacguauggcaucuaagaucggccgcugguacuccagaacaaugucaaagacuaaaaggauggguauggggcuguauguuaaguacgacggcgauccguggaccgacagugaggcucucgcccuuagcggagugauggucuccauggaggagccuggcugguacucuuucggguuugaaauaaaggauaaaaagugcgacgugcccuguauuggaaucgagauggugcacgaugguggcaaaacaacuuggcauagcgcugccaccgcaaucuauugccugauggggucaggacaguugcuaugggacacagucaccggcguuaauaugacucuguga

SEQ ID NO: 152398 - RNA, 1401 nt, Artificial Sequence; identical to SEQ ID NO: 152390
  derived and/or modified sequence opt3 from neuraminidase__InfluenzaB__AKA54805

SEQ ID NO: 152399 - RNA, 1401 nt, Artificial Sequence
  derived and/or modified sequence opt3 from neuraminidase__InfluenzaB__AKA54807
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucuccauggaggaaccuggcugguacucuuucggguuugaaauaaaagauaagaaaugcgacgugcccuguauuggaaucgagauggugcacgaugguggcaagacaacuuggcauagcgcugccaccgcaaucuauugccugauggggucaggacaguugcuaugggacacagucaccggcguuaacauuacucuguga

SEQ ID NO: 152400 - RNA, 1401 nt, Artificial Sequence
  derived and/or modified sequence opt3 from neuraminidase__InfluenzaB__AKA54809
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcauucaagaucggccgcugguacucuagaacaauguccaaaacuaagaggauggguauggggcuguauguuaaguacgacggcgauccguggaccgacucagaggcucucgcccuuaguggagugauggucagcauggaggaaccuggcugguacuccuuuggguucgaaauaaaagauaagaaaugcgacgugcccuguauuggaaucgagauggugcacgaugguggcaagacaacuuggcauucugcugccaccgcaaucuauugccugauggggagcggacaguugcuaugggacacagucaccggcguuaacaugacucuguga

SEQ ID NO: 152401 - RNA, 1401 nt, Artificial Sequence; identical to SEQ ID NO: 152390
  derived and/or modified sequence opt3 from neuraminidase__InfluenzaB__AKA54811

SEQ ID NO: 152402 - RNA, 1401 nt, Artificial Sequence
  derived and/or modified sequence opt3 from neuraminidase__InfluenzaB__AKA54813
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucuccauagaggaaccuggcugguacucuuucggguuugaaauuaaagauaagaaaugcgacgugcccuguaucggaaucgagauggugcacgaugguggcaagacaacuuggcauagcgcugccaccgcaauuuauugccugauggggucaggacaguugcuaugggacacagucaccggcguuaacaugacucuguga

SEQ ID NO: 152403 - RNA, 1401 nt, Artificial Sequence; identical to SEQ ID NO: 152390
  derived and/or modified sequence opt3 from neuraminidase__InfluenzaB__AKA54815

SEQ ID NO: 152404 - RNA, 1401 nt, Artificial Sequence
  derived and/or modified sequence opt3 from neuraminidase__InfluenzaB__AKA54817
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucuccauggaggaaccuggcugguacucuuucggguuugaaauaaaagauaagaaaugcgacgugcccuguauuggaguggagaugguccacgaugguggcaagacaacuuggcauagcgcugccaccgcaaucuauugccugauggggucaggacaguugcuaugggacacaguuaccggcgugaacaugacucuguga

SEQ ID NO: 152405 - RNA, 1401 nt, Artificial Sequence; identical to SEQ ID NO: 152390
  derived and/or modified sequence opt3 from neuraminidase__InfluenzaB__AKA54819

SEQ ID NO: 152406 - RNA, 1401 nt, Artificial Sequence; identical to SEQ ID NO: 152390
  derived and/or modified sequence opt3 from neuraminidase__InfluenzaB__AKA54821

SEQ ID NO: 152407 - RNA, 1401 nt, Artificial Sequence; identical to SEQ ID NO: 152390
  derived and/or modified sequence opt3 from neuraminidase__InfluenzaB__AKA54823

SEQ ID NO: 152408 - RNA, 1401 nt, Artificial Sequence; identical to SEQ ID NO: 152390
  derived and/or modified sequence opt3 from neuraminidase__InfluenzaB__AKA54825

SEQ ID NO: 152409 - RNA, 1401 nt, Artificial Sequence; identical to SEQ ID NO: 152390
  derived and/or modified sequence opt3 from neuraminidase__InfluenzaB__AKA54827

SEQ ID NO: 152410 - RNA, 1401 nt, Artificial Sequence
  derived and/or modified sequence opt3 from neuraminidase__InfluenzaB__AKA54829
augcugcccagcaccauccagacacucacucuuuuccugacguccggcgggguguuguuaucucuguacgucucagccagucuaagcuaucuccuguacuccgacauucuucugaaguugucuagaaccgagguuacagcuccuauaaugccacucgauugcgcaaacgccucgaaugugcaagcgguaaacaggucagcuacuaaaggagugaccccgcugcugcccgaaccugaguggacauauccacggcucagcugucccgguaguaccuuucagaagacuuuacugaucuccccucaccgcuucggcgaaacaaaaggaaauucugccccacuuauuauccgagagcccuuuauugcaugcgggccuaaggaauguaaacauuucgccuugacccacuacgcugcacagccaggcgguuauuacaacgggacgcgugaggacagaaauaagcugaggcaucuaaucagcgucaagcucggaaaaauaccgacuguggagaacuccaucuuucacauggccgcuuggucaggcagugccugccaugauggccgggaauggaccuauauugggguugacggacccgauagcaaugcgcugcuuaagaucaaauacggugaggcauacacagacacuuaucacucuuacgccaagaacauucugcgcacccaggaauccgcuuguaauugcaucggcggggauuguuauuugaugauaacagacggaccugccucaggcauuagcgagugcagauuccucaaaaucagggagggucggauuaucaaggaaaucuuuccaaccgggcgcgugaagcacacggaggaauguacuugcggauucgcaaguaacaaaacaauugagugugcuugccgagauaauucuuacaccgccaagagacccuuugucaaacugaacguggaaacugacacagcggagauaagguuaaugugcaccaagacguaucuggauaccccucggccaaaugacggcuccaucacaggccccugugagagcgauggggacgaaggaucggguggcauuaaagggggauucguacaucaacguauggccucuaagaucggccgcugguacuccagaacuaugucaaaaaccaagaggauggguauggggcucuauguuaaguacgacggcgauccguggacagacagugaggcacuugcucugagcggagugauggucuccauggaggaaccuggcugguacucuuuuggguucgaaauaaaagauaagaaaugcgacgugcccuguauuggaaucgagauggugcacgaugguggcaagacuaccuggcauagcgccgcuacagccaucuauugcuugauggggucaggacagcuacugugggacaccgucacuggcguuaacaugacgcucuga

SEQ ID NO: 152411 - RNA, 1401 nt, Artificial Sequence
  derived and/or modified sequence opt3 from neuraminidase__InfluenzaB__AKA54831
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacaggauagcaaugcacuccugaagaucaaauacggugaggccuacaccgacacauaucacucuuacgcuaagaacauucuucgcacucaagaauccgccuguaauugcaucggcggggauuguuaucugaugauaaccgacggacccgcaucaggcauuagcgagugcagauuuuugaaaaucagggagggucggauuaucaaggaaaucuucccuacagggcgcgugaagcacaccgaggaauguacgugcggauuugcuaguaacaaaacuauugagugugccugccgagauaauucuuacacagcgaagagaccauucgucaaacucaacguggaaaccgacacugccgagauaaggcugaugugcacaaagaccuauuuagauacgccccggccuaaugacggcuccaucaccggcccaugugagagcgauggggacgaaggaucggguggcauuaaagggggauuuguacaucagcguauggcaucuaagaucggccgcugguacuccagaacaaugucaaaaacuaagaggauggguauggggcuguauguuaaguacgacggcgaucccuggaccgacagugaggcucucgcccuuagcggagugauggucuccauggaggaaccgggcugguacucuuucggguuugaaauaaaagauaagaaaugcgacgugccuuguauuggaaucgagauggugcacgaugguggcaagacaacuuggcauagcgcugccaccgcaaucuauugccugauggggucaggacaguugcuaugggacacagucaccggcguuaacaugacucuguga

SEQ ID NO: 152412 - RNA, 1401 nt, Artificial Sequence; identical to SEQ ID NO: 152390
  derived and/or modified sequence opt3 from neuraminidase__InfluenzaB__AKA54833

SEQ ID NO: 152413 - RNA, 1401 nt, Artificial Sequence
  derived and/or modified sequence opt3 from neuraminidase__InfluenzaB__AKA54837
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaugggaacucugcaccacuuauugugcgcgagcccuucaucgccugcggaccuaaugaauguaaacauuuugcuuugacccacuacgcagcccagccaggcgguuauuacaacgggacgcgaggagaccguaauaagcugagacaucuaauuagcgucaaacucggcaagaucccgacuguggagaacuccauauuccacauggcugccuggucaggcagugcgugccaugaugggaaggaguggaccuauaucggaguugacggucccgauaauaacgcacugcuuaaagugaaguacggcgaagccuacacagacacuuaucacagcuacgcuaauaaaauucugaggacccaggagucugccuguaacugcaucgggggaaauuguuauuugaugauuacagauggcuccgcaucaggugucagcgaaugccgguuucucaagauccgcgaggggagaauaauuaaagagaucuucccuaccggaagggugaagcacacggaagaguguacuugcggcuuugcuaguaacaagacaauugaaugugccugccgggacaaucgcuacaccgcgaaacgaccauucguaaagcugaacguugagacugauacagccgaaaucagauuaaugugcaccgacacguaucuggauacccccaggccuaacgacggcucuaucacagggccaugugaguccgauggaaaugaggguagcggcgggauuaaaggaggcuuugugcaucaacggaugaagucgaaaauaggucguugguacucucgcacuauguccaagaccgaaagaauggggaugggccucuaugucaaauacgacggagaccccugggcagauucagacgcucuugccuucaguggcgugauggugagcaugaaggagccggggugguacuccuuuggauucgaaaucaaggauaaaaagugcgacgucccuuguauugguaucgagaugguucacgauggcgggaaagaaacauggcauucugcugccacugcaauauauugccugaugggaagcggccaguugcuaugggacaccgugacagguguagauauggcccuguga

SEQ ID NO: 152414 - RNA, 1401 nt, Artificial Sequence
  derived and/or modified sequence opt3 from neuraminidase__InfluenzaB__AKA54839
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaagaaguaacacuccugcugcccgagccugaauggaccuauccaaggcucagcugucccggaaguacuuuccagaaggccuuacugaucuccccucaccgguuuggugagacaaaaggcaauucugcaccacuuauuauccgcgaacccuucauugccugcgggccuaacgaguguaagcauuuugcuuugacccacuacgcagcccagccaggaggcuauuacaaugguacgcgaggggaccguaacaaacugagacaucuaaucagcgugaagcucggaaagauaccgacugucgaaaauuccaucuuccacauggcugccuggucaggcagugcgugccaugauggcaaagaguggaccuauauugggguggacggacccgauaacaaugcacugcuuaagguuaaauacggugaggccuacacagacacuuaucacagcuacgcuaacaagauccugaggacccaggaaucugccuguaauugcauuggcgggaacuguuauuugaugaucacagauggauccgcaucaggcgugagcgagugccgguuucucaaaauacgcgaggguagaauuaucaaggaaauuuucccuaccgggagggucaagcacacggaggaauguacuugcggauuugcuaguaauaaaacaaucgagugugccugccgggacaaccgcuacaccgcgaagcgaccauucgugaaacugaauguagaaacugauacagccgagaucagauuaaugugcaccgacacguaucuggauacccccaggccuaacgacggcucuauuacaggcccaugugaguccgauggggacaagggaagcgguggcauaaaagggggauuuguucaucaacggaugaagucgaaaaucggccguugguacucucgcacuauguccaagaccgaaagaauggguauggggcucuaugugaaguacgacggcgaucccugggcagacucagaugcucuugccuucaguggagucauggugagcaugaaagagccgggcugguacuccuuuggguucgaaauuaaggacaaaaagugcgaugugccuuguaucggaauagagaugguccacgacgguggcaaagaaacauggcauucugcugccacugcaauuuauugccugauggggagcggacaguugcuaugggauaccguuacaggcguggacauggcccuguga

SEQ ID NO: 152415 - RNA, 1401 nt, Artificial Sequence
  derived and/or modified sequence opt3 from neuraminidase__InfluenzaB__AKA54841
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacgaggguagcggcgggauaaagggaggcuuuguucaucaacggaugaaaucgaagaucggucguugguacucucgcacuauguccaaaaccgaaagaauggggaugggccucuaugugaaguacgacggagaucccugggcagacucagaugcucuugccuucaguggcgucauggugagcgugaaggagccggggugguacuccuuuggauucgaaauuaaagacaagaaaugcgaugucccuuguaucgguauagagaugguucacgacggcgggaaggaaacauggcauucugcugccacugcaauuuauugccugaugggaagcggccaguugcuaugggauaccgugacagguguagacaucgcccuguga

SEQ ID NO: 152416 - RNA, 1401 nt, Artificial Sequence
  derived and/or modified sequence opt3 from neuraminidase__InfluenzaB__AKA54843
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacgaggguagcggcgggauaaagggaggcuuuguucaucaacggaugaaaucgaagaucggucguugguacucucgcacuauguccaaaaccgaaagaauggggaugggccucuaugugaaguacgacggagaucccugggcagacucagaugcucuugccuucaguggcgucauggugagcgugaaggagccggggugguacuccuuuggauucgaaauuaaagacaagaaaugcgaugucccuuguaucgguauagagaugguucacgacggcgggaaggaaacauggcauucugcugccacugcaauuuauugccugaugggaagcggccaguugcuaugggauaccgugacagguguagacauggcccuguga

SEQ ID NO: 152417 - RNA, 1401 nt, Artificial Sequence
  derived and/or modified sequence opt3 from neuraminidase__InfluenzaB__AKA54845
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaugggaacucugcaccacuuauuauccgcgagcccuucauugccugcggaccuaaugaauguaaacauuuugcuuugacccacuacgcagcccagccaggcgguuauuacaacgggacgcgaggagaccguaauaagcugagacaucuaaucagcgugaaacucggcaagauaccgacugucgagaacuccaucuuccacauggcugccuggucaggcagugcgugccaugaugggaaggaguggaccuauauuggaguggacggucccgauaauaacgcacugcuuaaaguuaaguacggcgaagccuacacagacacuuaucacagcuacgcuaauaaaauccugaggacccaggagucugccuguaacugcauugggggaaauuguuauuugaugaucacagauggcuccgcaucaggugugagcgaaugccgguuucucaagauacgcgaggggagaauuaucaaagagauuuucccuaccggaagggucaagcacacggaagaguguacuugcggcuuugcuaguaacaagacaaucgaaugugccugccgggacaaucgcuacaccgcgaaacgaccauucgugaagcugaacguagagacugauacagccgaaaucagauuaaugugcaccgacacguaucuggauacccccaggccuaacgacggcucuauuacagggccaugugaguccgauggagacgaggguagcggcgggauaaaaggaggcuuuguucaucaacggaugaagucgaaaaucggucguugguacucucgcacuauguccaagaccgaaagaauggggaugggccucuaugugaaauacgacggagaucccugggcagacucagaugcucuugccuucaguggcgucauggugagcaugaaggagccggggugguacuccuuuggauucgaaauuaaggacaaaaagugcgaugugccuuguaucgguauagagaugguccacgacggcgggaaagaaacauggcauucugcugccacugcaauuuauugccugaugggaagcggccaguugcuaugggauaccguuacagguguggacauggcccuguga

SEQ ID NO: 152418 - RNA, 1401 nt, Artificial Sequence; identical to SEQ ID NO: 152222
  derived and/or modified sequence opt3 from neuraminidase__InfluenzaB__AKA54847

SEQ ID NO: 152419 - RNA, 1401 nt, Artificial Sequence
  derived and/or modified sequence opt3 from neuraminidase__InfluenzaB__AKA54849
augcugcccagcaccauccagacacucacucuuuuccugacguccggcgggguguuguuaucucuguacgucucagccagucuaagcuaucuccuguacuccgacauucuucugaaguuuucuucgaccgagauaacagcuccuacuaugccauuggauugcgcaaacgccucaaauguucaagcggugaacagaagcgcuaccaaaggaguaacacuccugcugccggaacccgaguggaccuauccuaggcucaguuguccagguuccacuuuccagaaggccuuacugaucucuccccaccgguuuggcgaaacaaaugggaacagcgcaccucuuauuauccgcgagccauucauugccugcggacccaaugaauguaaacauuuugcuuugacccacuacgcagcccagccuggcgguuauuacaacgggacgcgaggagaccguaauaagcugagacaucuaaucuccgugaaacucggcaagauaccaacugucgagaacucaaucuuccacauggcugccuggaguggcagcgcgugccaugaugggaaggaguggaccuauauuggaguggacgguccggauaauaacgcacugcuuaaaguuaaguacggcgaagccuacacagacacuuaucacucuuacgcuaauaaaauccugaggacccaggaguccgccuguaacugcauugggggaaauuguuauuugaugaucacagauggcucagcaagcggugugagugaaugccgguuucucaagauacgcgaggggagaauuaucaaagagauuuuccccaccggaagggucaagcacacggaagaguguacuugcggcuuugcuucuaacaagacaaucgaaugugccugccgggacaaucgcuacaccgcgaaacgaccuuucgugaagcugaacguagagacugauacagccgaaaucagauuaaugugcaccgacacguaucuggauaccccaaggcccaacgacggcuccauuacagggccuugugagagcgauggagacgaggguggcgggggaauaaaaggcgguuuuguucaucaacggaugaagucgaaaaucgggcguugguacucucgcacuauguccaagaccgaaagaaugggcaugggacucuaugugaaauacgacggcgauccaugggcagacucagaugcucuugccuucaguggggucauggugagcaugaaggagcccggaugguacuccuuugguuucgaaauuaaggacaaaaagugcgaugugccguguaucggcauagagaugguccacgacgggggaaaagaaacauggcauucugcugccacugcaauuuauugccugaugggcagcggucaguugcuaugggauaccguuacagggguggacauggcccuguga

SEQ ID NO: 152420 - RNA, 1401 nt, Artificial Sequence
  derived and/or modified sequence opt3 from neuraminidase__InfluenzaB__AKA54851
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacaucgacacauaucacagcuacgcuaacaagauucugaggacucaggagucugccuguaauugcaucgggggaaacuguuauuugaugauaaccgauggcuccgcaucaggugugagcgaaugccgguuucucaaaauucgcgaggggagaaucauuaaggagaucuucccuacaggaagggucaagcacaccgaagaguguacgugcggcuuugcuaguaauaaaacuaucgaaugugccugccgggacaaccgcuacacagcgaagcgaccauucgugaaacugaauguagagaccgauacugccgaaauuagauuaaugugcacagacaccuaucuggauacgcccaggccuaacgacggcucuauaaccgggccaugugaguccgauggagacaaggguagcggcgggaucaaaggaggcuuuguucaucaacggaugaagucgaaaauuggucguugguacucucgcacaauguccaagacugagagaauggggaugggccucuaugugaaguacgacggagaucccugggcagacucagaugcucuugccuucaguggcgucauggugagcaugaaagaaccggggugguacuccuuuggauucgagaucaaggacaaaaagugcgaugugccuuguauagguauugaaaugguccacgacggcgggaaagagaccuggcauucugcugccacagcaaucuauugccugaugggaagcggccaguugcuaugggauacuguuaccgguguggacauggcccuguga

SEQ ID NO: 152421 - RNA, 1401 nt, Artificial Sequence
  derived and/or modified sequence opt3 from neuraminidase__InfluenzaB__AKA54853
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacgaggguagcggcgggguuaagggaggcuuugugcaucaacggaugaaaucgaagauaggucguugguacucucgcacuauguccaaaaccgaaagaauggggaugggccucuaugucaaguacgacggagaucccugggcagacucagaugcucuugccuucaguggcgugauggugagcgucaaggagccggggugguacuccuuuggauucgaaaucaaagacaagaaaugcgauguuccuuguauugguaucgagauggugcacgacggcgggaaggaaacauggcauucugcugccacugcaauauauugccugaugggaagcggccaguugcuaugggauaccguaacagguguggacauggcccuguga

SEQ ID NO: 152422 - RNA, 1401 nt, Artificial Sequence
  derived and/or modified sequence opt3 from neuraminidase__InfluenzaB__AKA54855
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacuggauguagagacugacacagccgaaaucagauuaaugugcaccgauacguaucuggacacccccaggccuaaugauggcucuauuacagggccaugugaguccgacggagacaaggguagcggcgggauaaaaggaggcuuuguucaucaacggaugaagucgaaaaucggucguugguacucucgcacuauguccaagaccgagagaauggggaugggccucuaugugaaguacgauggagaccccugggcagauucagacgcucuugccuucaguggcgucauggugagcaugaaagaaccggggugguacuccuuuggauucgagauuaaggauaaaaagugcgacgugccuuguaucgguauagaaaugguccacgauggcgggaaagagacauggcauucugcugccacugcaauuuauugccugaugggaagcggccaguugcuaugggacaccguuacagguguggauauggcccuguga

SEQ ID NO: 152423 - RNA, 1401 nt, Artificial Sequence
  derived and/or modified sequence opt3 from neuraminidase__InfluenzaB__AKT07927
augcccccuagcaccauccagacacugacucucuuccuuacguccggcggggugcuguugucuuuauacgucucagccagucugagcuaucuacucuacuccgacauucugcuuaaguuuucuccaaccgagauaacagcuccgacuaugccccuggauugcgcaaacgccucgaauguucaagcggugaacagaucagcuaccaaaggaguaacauugcuccugccugaaccagaguggaccuaucccaggcugagcuguccugguaguacuuuccagaaggcccucuuaaucuccccacaccgguuuggcgaaacacgcggaaauucugcaccccugauuauccgagagccuuucauugccugcgggccaaacgaauguaaacauuuugcucuuacccacuacgcagcccagccgggcgguuauuacaaugggacgcguggagacagaaacaaguugaggcaucugaucagcgugaaacuaggcaagauacccacugucgaaaauuccaucuuccacauggcugccuggucaggcagugcgugccaugaugggaaggaguggaccuauauuggaguggacgguccugauaacaaugcacuccugaaaguuaaguacggcgaggccuacacagacacuuaucacagcuacgcuaacaaaauccuucggacccaggagucugccuguaauugcauugggggaaacuguuaucugaugaucacagauggcuccgcaucaggugugagcgaaugccgcuuuuugaagauaagagaggggaggauuaucaaagagauuuucccaaccggacgggucaagcacacggaagaguguacuugcggcuuugcuaguaauaagacaaucgaaugugccugccgcgacaacucuuacaccgcgaaacgacccuucgugaagcucaauguagagacugauacagccgaaaucagacugaugugcaccgacacguauuuagauaccccuaggccaaacgacggcuccauuacagggcccugugagagcgauggagacaaagguucgggcgggauaaagggaggcuuuguucaucaacggauggagucuaaaaucggucguugguacucccgcacuaugucaaagaccgaaagaauggggaugggccuguaugugaaauacgacggagauccguggacagacagugaugcacucgcuuucggcggggucauggugagcaugaaggagccuggaugguacuccuuugguuucgaaauuaaggacaaaaagugcgaugugcccuguaucggcauagagaugguccacgacgggggaaaagaaacuuggcauucugccgcuaccgccauuuauugccuuaugggcagcggucagcuguugugggauacaguuaccgggguggacauggcacuauga

SEQ ID NO: 152424 - RNA, 1401 nt, Artificial Sequence; identical to SEQ ID NO: 151135
  derived and/or modified sequence opt3 from neuraminidase__InfluenzaB__AKT07931

SEQ ID NO: 152425 - RNA, 1401 nt, Artificial Sequence
  derived and/or modified sequence opt3 from neuraminidase__InfluenzaB__AKT07933
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaaccuuccuccugcccgaaccugaguggacauauccaaggcugagcugucccgguaguaccuuucagaaggcacucuuaaucuccccucaccgguucggcgaaacuaaaggaaauucugccccacugauuauccgcgagcccuuuauugcuugcgggccuaacgaauguaagcauuucgcacuuacacacuacgccgcucagccaggcgguuauuacaaugggacccgaggagaccguaacaaauugagacaucugaucagcgugaagcuaggcaagauaccgacggucgaaaauuccaucuuucacauggccgcguggucaggcagugcaugccaugaugggaaagaguggacuuauauuggaguggacggucccgauaacaaugcccuccugaagguuaaauacggcgaggcuuacaccgacacauaucacagcuacgccaacaagauccuuaggacucaggagucugcauguaauugcauugggggaaacuguuaucugaugaucaccgauggcuccgcuucaggugugagcgaaugccgguucuugaaaauacgcgaggggagaauuaucaaggagauuuuuccuacaggaagggucaagcacaccgaagaguguacgugcggcuucgccaguaauaaaacuaucgaaugugcgugccgggacaacucuuacacagccaagcgcccauuugugaaacucaauguagagaccgauacugcagaaauccgacugaugugcacagacaccuauuuagauacgcccagaccuaacgacggcuccauuaccgggccaugugagagcgauggagacaaggguucgggcgggauaaaaggaggcuucguucaucaaaggauggagucuaagaucggucggugguacucccguacaaugucaaaaacugaacgcauggggaugggccuguaugugaaguacgacggagaucccugggcugacagugaugcccucgcuuuuagcggcgucaugguguccaugaaggagccggggugguacucuuucggauucgaaauuaaagacaagaaaugcgaugugccuuguaucgguauagagaugguccacgacggcgggaaggaaaccuggcauagcgccgcaacagccauuuauugccuuaugggaucaggccagcuguugugggauacuguuaccgguguggacauggcucuauga

SEQ ID NO: 152426 - RNA, 1401 nt, Artificial Sequence; identical to SEQ ID NO: 151135
  derived and/or modified sequence opt3 from neuraminidase__InfluenzaB__AKT07935

SEQ ID NO: 152427 - RNA, 1401 nt, Artificial Sequence; identical to SEQ ID NO: 151135
  derived and/or modified sequence opt3 from neuraminidase__InfluenzaB__AKT07937

SEQ ID NO: 152428 - RNA, 1401 nt, Artificial Sequence; identical to SEQ ID NO: 150977
  derived and/or modified sequence opt3 from neuraminidase__InfluenzaB__AKT07939

SEQ ID NO: 152429 - RNA, 1401 nt, Artificial Sequence; identical to SEQ ID NO: 151135
  derived and/or modified sequence opt3 from neuraminidase__InfluenzaB__AKT07941

SEQ ID NO: 152430 - RNA, 1401 nt, Artificial Sequence; identical to SEQ ID NO: 151135
  derived and/or modified sequence opt3 from neuraminidase__InfluenzaB__AKT07945

SEQ ID NO: 152431 - RNA, 1401 nt, Artificial Sequence
  derived and/or modified sequence opt3 from neuraminidase__InfluenzaB__AKT07947
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccagcaaugccguuggauugcgccaacgcgucgaauguucaagcugugaacagaucagccacuaaaggaguaacccuccugcugcccgaaccugaguggacauauccaaggcucagcugucccgguaguaccuuccagaaggcauuacugaucuccccucaccgguuuggcgaaacuaaaggaaauucugccccacuuauuauccgcgagcccuucauugcuugcgggccuaacgaauguaagcauuuugcauugacacacuacgccgcucagccaggcgguuauuacaaugggacccgaggagaccguaacaaacugagacaucuaaucagcgugaagcucggcaagauaccgacggucgaaaauuccaucuuccacauggccgcguggucaggcagugcaugccaugaugggaaagaguggacuuauauuggaguggacggucccgauaacaaugcccugcuuaagguuaaauacggcgaggcuuacaccgacacauaucacagcuacgccaacaagauccugaggacucaggagucugcauguaauugcauugggggaaacuguuauuugaugaucaccgauggcuccgcuucaggugugagcgaaugccgguuucucaaaauacgcgaggggagaauuaucaaggagauuuucccuacaggaagggucaagcacaccgaagaguguacgugcggcuuugccaguaauaaaacuaucgaaugugcgugccgggacaacucuuacacagccaagcgcccauucgugaaacugaauguagagaccgauacugcagaaauccgauuaaugugcacagacaccuaucuggauacgcccagaccuaacgacggcuccauuaccgggccaugugagagcgauggagacaaggguucgggcgggauaaaaggaggcuuuguucaucaaaggauggagucuaagaucggucggugguacucccguacaaugucaaaaacugaacgcauggggaugggccucuaugugaaguacgacggagaucccugggcugacagugaugcccuugcuuucagcggcgucaugguguccaugaaggagccggggugguacucuuuuggauucgaaauuaaagacaagaaaugcgaugugccuuguaucggugucgacaugguucacgauugcggcaaggagaccuggcauagcgccgcaacagccauauauugucugauggggucaggacaguugcuaugggacacugugaccggcguagauauggcucuguga

SEQ ID NO: 152432 - RNA, 1401 nt, Artificial Sequence; identical to SEQ ID NO: 152390
  derived and/or modified sequence opt3 from neuraminidase__InfluenzaB__AKU40585

SEQ ID NO: 152433 - RNA, 1401 nt, Artificial Sequence; identical to SEQ ID NO: 152390
  derived and/or modified sequence opt3 from neuraminidase__InfluenzaB__AKU40596

SEQ ID NO: 152434 - RNA, 1401 nt, Artificial Sequence
  derived and/or modified sequence opt3 from neuraminidase__InfluenzaB__AKU40607
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaacuccauuggauugcgcaaacgccucgaaugcgcaagcugugaacaggucagccaccaaaggaguaacaccgcuccugcccgaaccugaguggaccuauccacggcugagcugucccgguaguacuuuccagaaggcacucuuaaucuccccucaccgcuuuggcgaaacaaaaggaaauucugccccacugauuauccgagagcccuucauugcuugcgggccuaaggaauguaaacauuuugcacuuacccacuacgccgcucagccaggcgguuauuacaacgggacgcgugaggacagaaauaaguugaggcaucugaucagcgugaagcuaggaaaaauaccgacugucgagaacuccaucuuccacauggccgcguggucaggcagugcaugccaugauggccgggaauggaccuauauugggguggacggacccgauagcaaugcccuccugaagaucaaauacggugaggcuuacacagacacuuaucacucuuacgccaagaacauucuucgcacccaggaauccgcauguaauugcaucggcggggauuguuaucugaugauaacagacggaccugcuucaggcauuagcgagugcagauuuuugaaaaucagggagggucggauuaucaaggaaaucuucccaaccgggcgcguuaagcacacggaggaauguacuugcggauuugccaguaacaaaacaauugagugugcgugccgagauaauucuuacaccgccaagagacccuucgugaaacucaacgucgaaacugacacagcagagauaaggcugaugugcaccaagacguauuuagauaccccucggccaaaugacggcuccaucacaggccccugugagagcgauggggacgaaggaucggguggcauuaaagggggauuugugcaucaacguauggcuucuaagaucggccgcugguacuccagaacuaugucaaaaaccaagaggauggguauggggcuguauguaaaguacgacggcgauccguggacagacagugaggcccucgcucuuagcggaguuaugguguccauggaggaaccuggcugguacucuuucggguuugaaauaaaagauaagaaaugcgacguccccuguauuggaaucgagauggugcacgaugguggcaagacuaccuggcauagcgccgcaacagccaucuauugccugauggggucaggacaguugcuaugggacaccgugacuggcgucaacaugacgcuguga

SEQ ID NO: 152435 - RNA, 1401 nt, Artificial Sequence
  derived and/or modified sequence opt3 from neuraminidase__InfluenzaB__AKU40618
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucuccauggaggaaccuggcugguacucuuucggguuugaaauaaaagauaacaagugcgacgugcccuguauuggaaucgagauggugcacgaugguggcaaaacaacuuggcauagcgcugccaccgcaaucuauugccugauggggucaggacaguugcuaugggacacagucaccggcguuaauaugacucuguga

SEQ ID NO: 152436 - RNA, 1401 nt, Artificial Sequence
  derived and/or modified sequence opt3 from neuraminidase__InfluenzaB__AKU40640
augcugcccagcaccauccagacacucacucuuuuccugacguccggcgggguguuguuaucucuguacgucucagccagucuaagcuaucuccuguacuccgacauucuucugaaguuuucuagaaccgagauagcugcaccuaucaugccauuggauugcgccaacgcgucgaauguucaagcugugaacaggucagccacaaaaggaguagcacuccugcugccggaacccgaguggacuuauccucggcucagcuguccagguaguaccuuccagaaggccuuacugauuucuccccaccgcuuuggcgaaacaaaaggaaauuccgcuccucuuaucauucgagagccauucaucgcaugcgggcccaaggaauguaaacauuuugccuugacccacuacgcugcccagccuggcgguuauuacaacgggacucgugaggacagaaauaagcugaggcaucuaauaagcgugaagcucggaaaaaucccaacagucgagaacuccauuuuccacauggcggcauggucaggcagugccugccaugauggccgggaauggaccuauaucgggguggacggaccggauaauaacgcucugcuuaagauuaaauacggugaggccuacacggacacuuaucacagcuacgcaaagaauauccugcgcacccaggaaucugcuuguaacugcauaggcggggauuguuauuugaugauuacagacggacccgccuccggcaucucagagugcagauuucucaaaauuagggagggucggaucaucaaggaaauuuucccuacugggcgcguuaagcacaccgaggaauguacaugcggauuugcgagcaauaaaaccauagagugugccugccgagauaacaguuacacggcaaagagaccauucgugaaacugaaugucgaaacugacacagcugagaucagguuaaugugcaccgagacuuaucuggauacaccccggccuaacgacggcucuauuaccggcccaugugaauccaauggggauaagggaagcgguggcaucaaagggggauuugugcaucaacguauggccucgaagauaggccgcugguacucuagaacgauguccaaaaccaagaggauggguauggggcucuauguaaaguacgacggcgaccccuggacagauucagaggcucuugcccugaguggaguuauggugagcauggaggaaccgggcugguacuccuucggguuugaaauuaaagacaagaaaugcgaugucccuuguaucggaaucgagauggugcacgacgguggcaagacuaccuggcauucugcagccacagcuauuuauugcuugauggggagcggacagcuacugugggauacugugaccggcgucaacaugacacucuga

SEQ ID NO: 152437 - RNA, 1401 nt, Artificial Sequence; identical to SEQ ID NO: 152390
  derived and/or modified sequence opt3 from neuraminidase__InfluenzaB__AKU40662

SEQ ID NO: 152438 - RNA, 1401 nt, Artificial Sequence
  derived and/or modified sequence opt3 from neuraminidase__InfluenzaB__AKU40673
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaagcgaguggacauauccucggcugaguuguccagguuccaccuuccagaaggcccucuuaaucucuccccaccgcuuuggcgaaacuaaagggaauagcgcaccucugauuauccgagagccauucauugccugcggacccaaggaauguaaacauuuugcucuuacacacuacgcagcccagccuggcgguuauuacaacgggacccgugaggacagaaauaaguugaggcaucugaucuccgucaagcuaggaaaaauaccaacgguggagaacucaaucuuccacauggcugccuggaguggcagcgcgugccaugauggccgggaauggacuuauauugggguugacggaccggauucuaaugcacuccugaagaucaaauacggugaggccuacaccgacacauaucacuccuacgcuaagaacauucuucgcacucaggaaucagccuguaauugcaucggcggggauuguuaucugaugauaaccgacggacccgcaagcggcauuagugagugcagauuuuugaaaaucagggagggucggauuaucaaggaaaucuucccuacagggcgcgugaagcacaccgaggaauguacgugcggauuugcuucuaacaaaacuauugagugugccugccgagauaauuccuacacagcgaagagaccauucgucaaacucaacguggaaaccgacacugccgagauaaggcugaugugcacaaagaccuauuuagauacgccccggccuaaugacggcagcaucaccggcccaugugagucggauggggacgaaggaucugguggcauuaaagggggauuuguacaucaacguauggcauccaagaucggccgcugguacucaagaacaaugaguaaaacuaagaggauggguauggggcuguauguuaaguacgacggcgaucccuggaccgacagcgaggcucucgcccuuuccggagugauggucucuauggaggaaccgggcugguacagcuucggguuugaaauaaaagauaagaaaugcgacgugccuuguauuggaaucgagauggugcacgaugguggcaagacaacuuggcauucagcugccaccgcaaucuauugccugauggggaguggacaguugcuaugggacacagucaccggcguuaacaugacucuguga

SEQ ID NO: 152439 - RNA, 1401 nt, Artificial Sequence; identical to SEQ ID NO: 152390
  derived and/or modified sequence opt3 from neuraminidase__InfluenzaB__AKU40684

SEQ ID NO: 152440 - RNA, 1401 nt, Artificial Sequence; identical to SEQ ID NO: 152390
  derived and/or modified sequence opt3 from neuraminidase__InfluenzaB__AKU40695

SEQ ID NO: 152441 - RNA, 1401 nt, Artificial Sequence; identical to SEQ ID NO: 152390
  derived and/or modified sequence opt3 from neuraminidase__InfluenzaB__AKU40706

SEQ ID NO: 152442 - RNA, 1401 nt, Artificial Sequence; identical to SEQ ID NO: 152390
  derived and/or modified sequence opt3 from neuraminidase__InfluenzaB__AKU40717

SEQ ID NO: 152443 - RNA, 1401 nt, Artificial Sequence
  derived and/or modified sequence opt3 from neuraminidase__InfluenzaB__AKU40728
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugcgcaagcugugaacaggucagccacuaaaggaguaaccccgcuccugcccgaaccugaguggacauauccacggcugagcugucccgguaguaccuuccagaaggcacucuuaaucuccccucaccgcuuuggcgaaacuaaaggaaauucugccccacugauuauccgagagcccuucauugcuugcgggccuaaggaauguaaacauuuugcacuuacacacuacgccgcucagccaggcgguuauuacaacgggacccgugaggacagaaauaaguugaggcaucugaucagcgugaagcuaggaaaaauaccgacggucgagaacuccaucuuccacauggccgcguggucaggcagugcaugccaugauggccgggaauggacuuauauugggguggacggacccgauagcaaugcccuccugaagaucaaauacggugaggcuuacaccgacacauaucacucuuacgccaagaacauucuucgcacucaggaauccgcauguaauugcaucggcggggauuguuaucugaugauaaccgacggaccugcuucaggcauuagcgagugcagauuuuugaaaaucagggagggucggauuaucaaggaaaucuucccaacagggcgcguuaagcacaccgaggaauguacgugcggauuugccaguaacaaaacuauugagugugcgugccgagauaauucuuacacagccaagagacccuucgugaaacucaacgucgaaaccgacacugcagagauaaggcugaugugcacaaagaccuauuuagauacgccucggccaaaugacggcuccaucaccggccccugugagagcgauggggacgaaggaucggguggcauuaaagggggauuugugcaucaacguauggcuucuaagaucggccgcugguacuccagaacaaugucaaaaacuaagaggauggguauggggcuguauguaaaguacgacggcgauccguggaccgacagugaggcccucgcucuuagcggaguuaugguguccauggaggaaccuggcugguacucuuucggguuugaaauaaaagauaagaaaugcgacguccccuguauuggaaucgagauggugcacgaugguggcaagacaacuuggcauagcgccgcaaccgccaucuauugccugauggggucaggacaguugcuaugggacacagugaccggcgucaacaugacucuguga

SEQ ID NO: 152444 - RNA, 1401 nt, Artificial Sequence
  derived and/or modified sequence opt3 from neuraminidase__InfluenzaB__AKU40739
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugagaccuacacagacacuuaucacucuuacgccaagaacauucuucgcacccaggaauccgcuuguaauugcaucggcggggauuguuaucugaugauaacagacggaccugccucaggcauuagcgagugcagauuuuugaaaaucagggagggucggauuaucaaggaaaucuucccaaccgggcgcgugaagcacacggaggaauguacuugcggauuugcaaguaacaaaacaauugagugugcuugccgagauaauucuuacaccgccaagagacccuucgucaaacucaacguggaaacugacacagcggagauaaggcugaugugcaccaagacguauuuagauaccccucggccaaaugacggcuccaucacaggccccugugagagcgauggggacgaaggaucggguggcauuaaagggggauuuguacaucaacguauggccucuaagaucggccgcugguacuccagaacuaugucaaaaaccaagaggauggguauggggcuguauguuaaguacgacggcgauccguggacagacagugaggcacucgcucuuagcggagugauggucuccauggaggaaccuggcugguacucuuucggguuugaaauaaaagauaagaaaugcgacgugcccuguauuggaaucgagauggugcacgaugguggcaagacuaccuggcauagcgccgcuacagccaucuauugccugauggggucaggacaguugcuaugggacaccgucacuggcguuaacaugacgcuguga

SEQ ID NO: 152445 - RNA, 1401 nt, Artificial Sequence
  derived and/or modified sequence opt3 from neuraminidase__InfluenzaB__AKU40750
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaucccgcuccugcccgaaccugaguggaccuauccacggcugagcugucccgguaguacauuccagaaggcccucuuaauuuccccucaccgcuuuggcgaaaccaaaggaaauucugcaccacugaucauucgagagcccuucaucgccugcgggccuaaggaauguaaacauuuugcucuuacucacuacgcagcccagccaggcgguuauuacaacgggacacgugaggacagaaauaaguugaggcaucugauaagcgucaagcuaggaaaaaucccgaccguggagaacuccauuuuccacauggcugccuggucaggcagugcgugccaugauggccgggaauggacguauaucgggguugacggacccgauagcaaugcacuccugaagauuaaauacggugaggccuacacugacaccuaucacucuuacgcuaagaacauccuucgcacacaggaauccgccuguaauugcauaggcggggauuguuaucugaugauuacugacggaccugcaucaggcaucagcgagugcagauuuuugaaaauuagggagggucggaucaucaaggaaauuuucccaaccgggcgcgugaagcacacagaggaauguaccugcggauuugcuaguaacaaaacgauagagugugccugccgagauaauucuuacacugcgaagagacccuucgucaaacucaacguggaaacagacaccgccgagaucaggcugaugugcacuaagacauauuuagauaccccucggccaaaugacggcuccauuacgggccccugugagagcgauggggacgaaggaucggguggcaucaaagggggauuuguacaucaacguauggcaucuaagauaggccgcugguacuccagaaccaugucaaaaacaaagaggauggguauggggcuguauguuaaguacgacggcgauccguggacugacagugaggcucucgcccuuagcggagugauggucuccauggaggaaccuggcugguacucuuucggguuugaaauuaaagauaagaaaugcgacgugcccuguaucggaaucgagauggugcacgaugguggcaagaccacauggcauagcgcugccacugcaauuuauugccugauggggucaggacaguugcuaugggacaccgucacaggcguuaacaugacccuguga

SEQ ID NO: 152446 - RNA, 1401 nt, Artificial Sequence; identical to SEQ ID NO: 152390
  derived and/or modified sequence opt3 from neuraminidase__InfluenzaB__AKU40761

SEQ ID NO: 152447 - RNA, 1401 nt, Artificial Sequence; identical to SEQ ID NO: 152390
  derived and/or modified sequence opt3 from neuraminidase__InfluenzaB__AKU40772

SEQ ID NO: 152448 - RNA, 1401 nt, Artificial Sequence; identical to SEQ ID NO: 152390
  derived and/or modified sequence opt3 from neuraminidase__InfluenzaB__AKU40783

SEQ ID NO: 152449 - RNA, 1401 nt, Artificial Sequence
  derived and/or modified sequence opt3 from neuraminidase__InfluenzaB__AKU40794
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacacuucgaaugugcaagccguaaacaggucagcgaccaaaggagugacaccgcuccugcccgaaccugaguggaccuauccacggcugagcugucccgguaguacuuuccagaaggcucucuuaaucuccccucaccgcuuuggcgaaacaaaagggaagucugccccacugauuauccgagagcccuucauugcaugcggaccuaaagaauguaagcauuuugcccuuacccacuacgcugcacagccaggcgguuauuacaaugggacgcgugaggacagaaacaaguugaggcaucugaucagcgucaaacuaggaaagauaccgacuguggaaaauuccaucuuccacauggccgcuuggucaggcagugccugccaugauggccgggaauggaccuauauugggguugacggacccgauagcaacgcgcuccugaaaaucaaguacggugaggcauacacagacacuuaucacucuuacgccaaaaauauucuucgcacccaggaauccgcuuguaacugcaucggcggggauuguuaucugaugauaacagacggaccugccucaggcauuagcgagugcagauuuuugaagaucagggagggucggauuaucaaggaaaucuucccaaccgggcgcgugaaacacacggaggaauguacuugcggauuugcaaguaauaagacaauugagugugcuugccgagauaacucuuacaccgccaaaagacccuucgucaagcucaauguggaaacugacacagcggagauaaggcugaugugcaccaaaacguauuuagauaccccucggccaaacgacggcuccaucacaggccccugugagagcgauggggacgaaggaucggguggcauuaaagggggauuuguacaucaacguauggccucuaagaucggccgcugguacuccagaacuaugucaaagaccaagaggauggguauggggcuguauguuaaauacgacggcgauccguggacagacagugaggcacucgcucuuagcggagugauggucuccauggaggagccuggcugguacucuuucggguuugaaauaaaggauaaaaagugcgacgugcccuguauuggaaucgagauggugcacgaugguggcaaaacuaccuggcauagcgccgcuacagccaucuauugccugauggggucaggacaguugcuaugggacaccgucacuggcguuaauaugacgcuguga

SEQ ID NO: 152450 - RNA, 1401 nt, Artificial Sequence; identical to SEQ ID NO: 152390
  derived and/or modified sequence opt3 from neuraminidase__InfluenzaB__AKU40805

SEQ ID NO: 152451 - RNA, 1401 nt, Artificial Sequence; identical to SEQ ID NO: 152390
  derived and/or modified sequence opt3 from neuraminidase__InfluenzaB__AKU40816

SEQ ID NO: 152452 - RNA, 1401 nt, Artificial Sequence; identical to SEQ ID NO: 152390
  derived and/or modified sequence opt3 from neuraminidase__InfluenzaB__AKU40827

SEQ ID NO: 152453 - RNA, 1401 nt, Artificial Sequence; identical to SEQ ID NO: 152390
  derived and/or modified sequence opt3 from neuraminidase__InfluenzaB__AKU40838

SEQ ID NO: 152454 - RNA, 1401 nt, Artificial Sequence; identical to SEQ ID NO: 152390
  derived and/or modified sequence opt3 from neuraminidase__InfluenzaB__AKU40849

SEQ ID NO: 152455 - RNA, 1401 nt, Artificial Sequence; identical to SEQ ID NO: 152390
  derived and/or modified sequence opt3 from neuraminidase__InfluenzaB__AKU40860

SEQ ID NO: 152456 - RNA, 1401 nt, Artificial Sequence
  derived and/or modified sequence opt3 from neuraminidase__InfluenzaB__AKU40871
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggaguggccccgcuccugcccgaaccugaguggaccuauccacggcugagcugucccgguaguacauuccagaaggcacucuuaaucuccccucaccgcuuuggcgaaaccaaaggaaauucugccccacugauuauccgagagcccuucauugcuugcgggccuaaggaauguaaacauuuugcacuuacucacuacgccgcucagccaggcgguuauuacaacgggacacgugaggacagaaauaaguugaggcaucugaucagcgucaagcuaggaaaaauaccgaccguggagaacuccaucuuccacauggccgcguggucaggcagugcaugccaugauggccgggaauggacguauauugggguugacggacccgauagcaaugcccuccugaagaucaaauacggugaggcuuacacugacaccuaucacucuuacgccaagaacauucuucgcacacaggaauccgcauguaauugcaucggcggggauuguuaucugaugauaacugacggaccugcuucaggcauuagcgagugcagauuuuugaaaaucagggagggucggauuaucaaggaaaucuucccaaccgggcgcgugaagcacacagaggaauguaccugcggauuugccaguaacaaaacgauugagugugcgugccgagauaauucuuacacugccaagagacccuucgucaaacucaacguggaaacagacaccgcagagauaaggcugaugugcacuaagacauauuuagauaccccucggccaaaugacggcuccaucacgggccccugugagagcgauggggacgaaggaucggguggcauuaaagggggauuuguacaucaacguauggcuucuaagaucggccgcugguacuccagaaccaugucaaaaacaaagaggauggguauggggcuguauguuaaguacgacggcgauccguggacugacagugaggcccucacccuuagcggagugauggucuccauggaggaaccuggcugguacucuuucggguuugaaauaaaagauaagaaaugcgacgugcccuguauuggaaucgagauggugcacgaugguggcaagacaacuuggcauagcgcugccaccgcaaucuauugccugauggggucaggacaguugcuaugggacacagucaccggcguuaacaugacucuguga

SEQ ID NO: 152457 - RNA, 1401 nt, Artificial Sequence; identical to SEQ ID NO: 152390
  derived and/or modified sequence opt3 from neuraminidase__InfluenzaB__AKU40882

SEQ ID NO: 152458 - RNA, 1401 nt, Artificial Sequence
  derived and/or modified sequence opt3 from neuraminidase__InfluenzaB__AKU40893
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcgugaagcucggcaagauaccgacugucgaaaauuccaucuuccacauggcugccuggucaggcagugcgugccaugaugggaaagaguggaccuauauuggaguggacggucccgauaacaaugcacugcuuaagguuaaauacggcgaggccuacacagacacuuaucacagcuacgcuaacaagauccugaggacccaggagucugccuguaauugcauugggggaaacuguuauuugaugaucacagauggcuccgcaucaggugugagcgaaugccgguuucucaaaauacgcgaggggagaauuaucaaggagauuuucccuaccggaagggucaagcacacggaagaguguacuugcggcuuugcuaguaauaaaacaaucgaaugugccugccgggacaaccgcuacaccgcgaagcgaccauucgugaaacugaauguagagacugauacagccgaaaucagauuaaugugcaccgacacguaucuggauacccccaggccuaacgacggcucuauuacagggccaugugaguccgauggagacaaggguagcggcgggauaaaaggaggcuuuguucaucaacggaugaagucgaaaaucggucguugguacucucgcacuauguccaagaccgagagaauggggaugggccucuaugugaaguacgacggagaucccugggcagacucaggcgcucuugccuucaguggggucauggugagcaugaaagaaccgggaugguacuccuuugguuucgagauuaaggauaaaaagugcgacgugccuuguaucggcauagaaaugguccacgaugggggaaaagagacauggcauucugcugccacugcaauuuauugccugaugggcagcggucaguugcuaugggacaccguuacagggguggauauggcccuguga

SEQ ID NO: 152459 - RNA, 1401 nt, Artificial Sequence; identical to SEQ ID NO: 152390
  derived and/or modified sequence opt3 from neuraminidase__InfluenzaB__AKU40904

SEQ ID NO: 152460 - RNA, 1401 nt, Artificial Sequence
  derived and/or modified sequence opt3 from neuraminidase__InfluenzaB__AKU40915
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucccuauggaggaacccggcugguacuccuucggguuugaaauaaaagauaagaaaugcgacgugccauguauuggaaucgagauggugcacgaugguggcaagacaacuuggcauucugcugccaccgcaaucuauugccugauggggagcggacaguugcuaugggacacagucaccggcguuaacaugacucuguga

SEQ ID NO: 152461 - RNA, 1401 nt, Artificial Sequence; identical to SEQ ID NO: 152390
  derived and/or modified sequence opt3 from neuraminidase__InfluenzaB__AKU40926

SEQ ID NO: 152462 - RNA, 1401 nt, Artificial Sequence; identical to SEQ ID NO: 152444
  derived and/or modified sequence opt3 from neuraminidase__InfluenzaB__AKU40937

SEQ ID NO: 152463 - RNA, 1401 nt, Artificial Sequence; identical to SEQ ID NO: 152390
  derived and/or modified sequence opt3 from neuraminidase__InfluenzaB__AKU40948

SEQ ID NO: 152464 - RNA, 1401 nt, Artificial Sequence; identical to SEQ ID NO: 152390
  derived and/or modified sequence opt3 from neuraminidase__InfluenzaB__AKU40959

SEQ ID NO: 152465 - RNA, 1401 nt, Artificial Sequence; identical to SEQ ID NO: 152390
  derived and/or modified sequence opt3 from neuraminidase__InfluenzaB__AKU40970

SEQ ID NO: 152466 - RNA, 1401 nt, Artificial Sequence; identical to SEQ ID NO: 152390
  derived and/or modified sequence opt3 from neuraminidase__InfluenzaB__AKU40981

SEQ ID NO: 152467 - RNA, 1401 nt, Artificial Sequence; identical to SEQ ID NO: 152390
  derived and/or modified sequence opt3 from neuraminidase__InfluenzaB__AKU40991

SEQ ID NO: 152468 - RNA, 1401 nt, Artificial Sequence; identical to SEQ ID NO: 152390
  derived and/or modified sequence opt3 from neuraminidase__InfluenzaB__AKU41002

SEQ ID NO: 152469 - RNA, 1401 nt, Artificial Sequence; identical to SEQ ID NO: 152390
  derived and/or modified sequence opt3 from neuraminidase__InfluenzaB__AKU41013

SEQ ID NO: 152470 - RNA, 1401 nt, Artificial Sequence; identical to SEQ ID NO: 152390
  derived and/or modified sequence opt3 from neuraminidase__InfluenzaB__AKU41024

SEQ ID NO: 152471 - RNA, 1401 nt, Artificial Sequence; identical to SEQ ID NO: 150977
  derived and/or modified sequence opt3 from neuraminidase__InfluenzaB__EPI173278

SEQ ID NO: 152472 - RNA, 1401 nt, Artificial Sequence; identical to SEQ ID NO: 150977
  derived and/or modified sequence opt3 from neuraminidase__InfluenzaB__EPI498049

SEQ ID NO: 152473 - RNA, 1401 nt, Artificial Sequence; identical to SEQ ID NO: 150977
  derived and/or modified sequence opt3 from neuraminidase__InfluenzaB__AFH57913

SEQ ID NO: 152474 - RNA, 1401 nt, Artificial Sequence; identical to SEQ ID NO: 150977
  derived and/or modified sequence opt3 from neuraminidase__InfluenzaB__EPI827074

SEQ ID NO: 152475 - RNA, 1401 nt, Artificial Sequence; identical to SEQ ID NO: 150977
  derived and/or modified sequence opt3 from neuraminidase__InfluenzaB__EPI244698

SEQ ID NO: 152476 - RNA, 1401 nt, Artificial Sequence; identical to SEQ ID NO: 150977
  derived and/or modified sequence opt3 from neuraminidase__InfluenzaB__EPI244701

SEQ ID NO: 152477 - RNA, 1401 nt, Artificial Sequence; identical to SEQ ID NO: 152390
  derived and/or modified sequence opt3 from neuraminidase__InfluenzaB__EPI540672

SEQ ID NO: 152478 - RNA, 1401 nt, Artificial Sequence; identical to SEQ ID NO: 152390
  derived and/or modified sequence opt3 from neuraminidase__InfluenzaB__EPI829465

SEQ ID NO: 152479 - RNA, 1401 nt, Artificial Sequence
  derived and/or modified sequence opt3 from neuraminidase__InfluenzaB__EPI684428
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuacuaugccauuggauugcgcaaacgccucgaaugugcaagcgguaaacaggucaaccacaaaaggagugaccccgcuuuuccccgaaccugaguggacuuauccacggcugagcugucccgguaguacauuucagaaggcucugcucauauccccucaccgcuucggcgaaaccaaaggaaauucugccccauuaaucauucgagagcccuuuaucgcaugcgggccuaaggaauguaaacauuucgcccugacgcacuacgcugcacagccaggcgguuauuacaacgggacucgugaggacagaaauaagcucaggcauuugauuagcgucaagcugggaaaaaucccgaccguggagaacuccauauuucacauggccgcuuggucaggcagugccugccaugauggccgggaauggacauauaucgggguugacggacccgauagcaaugcgcuacucaagauuaaauacggugaggcauacacugacaccuaucacucuuacgccaagaacauccugcgcacacaggaauccgcuuguaauugcauuggcggggauuguuaucuuaugaucaccgacggaccugccucaggcgugagcgagugcagauuccugaaaauaagggagggucggauuaucaaggaaauuuuuccaacggggcgcgucaagcacacugaggaauguacaugcggauucgcaaguaacaaaaccaucgagugugcuugccgagauaauagauacacugccaagaggcccuuugugaaauugaacguagaaacagacaccgcggagauccggcucaugugcacgaagaccuaucuggauacaccucguccaaaugacggcucuauuacuggccccugugaguccgauggggacgaaggaagcgguggcauaaaagggggauucguucaucaacgcauggccucgaagaucggcagaugguacucuaggaccauguccaaaacaaagcggauggguaugggguuauaugugaaguacgacggcgauccguggacugacucagaggcacuggcucucaguggagucauggugagcauggaggaaccuggcugguacuccuuuggguucgaaauuaaagauaagaaaugcgacgugcccuguaucggaauagagaugguccacgaugguggcaagaccacauggcauucugccgcuaccgccauuuauugccuuauggggagcggacagcuguugugggacacuguuacgggcgugaacaugacacuauga

SEQ ID NO: 152480 - RNA, 1401 nt, Artificial Sequence; identical to SEQ ID NO: 150999
  derived and/or modified sequence opt3 from neuraminidase__InfluenzaB__AFH58451

SEQ ID NO: 152481 - RNA, 1401 nt, Artificial Sequence; identical to SEQ ID NO: 150977
  derived and/or modified sequence opt3 from neuraminidase__InfluenzaB__EPI173280

SEQ ID NO: 152482 - RNA, 1401 nt, Artificial Sequence; identical to SEQ ID NO: 150977
  derived and/or modified sequence opt3 from neuraminidase__InfluenzaB__EPI186302

SEQ ID NO: 152483 - RNA, 1401 nt, Artificial Sequence
  derived and/or modified sequence opt3 from neuraminidase__InfluenzaB__EPI636339
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucguggccugcgggccuaacgaauguaagcauuuugcuuugacccacuacgcagcccagccaggcgguuauuacaaugggacgcgaggagaccguaacaaacugagacaucuaauuagcgucaagcucggcaagaucccgacuguggaaaauuccauauuccacauggcugccuggucaggcagugcgugccaugaugggaaagaguggaccuauaucggaguugacggucccgauaacaaugcacugcuuaaggugaaauacggcgaggccuacacagacacuuaucacagcuacgcuaacaauauucugaggacccaggagucugccuguaacugcaucgggggaaauuguuauuugaugauuacagauggcuccgcaucaggugucagcgaaugccgguuucucaagauccgcgaggggagaauaauuaaagagaucuucccuaccggaagggugaagcacacggaagaguguacuugcggcuuugcuaguaacaagacaauugaaugugccugccgggacaaucgcuacaccgcgaaacgaccauucguaaagcugaacguugagacugauacagccgaaaucagauuaaugugcaccgacacguaucuggauacccccaggccuaacgacggcucuaucacagggccaugugaguccgauggagacaaagguagcggcgggauuaagggaggcuuugugcaucaacggaugaaaucgaagauaggucguugguacucucgcacuauguccaaaaccgagagaauggggaugggccucuaugucaaguacggaggcgaccccugggcagauucagacgcucuugccuucaguggggugauggugagcaugaaggaaccgggaugguacuccuuugguuucgagaucaaagauaagaaaugcgacgucccuuguauuggcaucgaaaugguucacgaugggggaaaggagacauggcauucugcugccacugcaauauauugccugaugggcagcggucaguugcuaugggacaccgugacagggguagauauggcccuguga

SEQ ID NO: 152484 - RNA, 1401 nt, Artificial Sequence; identical to SEQ ID NO: 152483
  derived and/or modified sequence opt3 from neuraminidase__InfluenzaB__EPI645996

SEQ ID NO: 152485 - RNA, 1401 nt, Artificial Sequence
  derived and/or modified sequence opt3 from neuraminidase__InfluenzaB__EPI539770
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugcgcaagcugugaacaggucagccacuaaaggaguaaccccgcuccugcccgaaccugaguggacauauccacggcugagcugucccgguaguaccuuccagaaggcacucuuaaucuccccucaccgcuuuggcgaaacuaaaggaaauucugccccacugauuauccgagagcccuucauugcuugcgggccuaaggaauguaaacauuuugcacuuacacacuacgccgcucagccaggcgguuauuacaacgggacccgugaggacagaaauaaguugaggcaucugaucagcgugaagcuaggaaaaauaccgacggucgagaacuccaucuuccacauggccgcguggucaggcagugcaugccaugauggccgggaauggacuuauauugggguggacggacccgauagcaaugcccuccugaagaucaaauacggugaggcuuacaccgacacauaucacucuuacgccaagaacauucuucgcacucaggaauccgcauguaauugcaucggcggggauuguuaucugaugauaaccgacggaccugcuucaggcauuagcgagugcagauuuuugaaaaucagggagggucggauuaucaaggaaaucuucccaacagggcgcguuaagcacaccgaggaauguacgugcggauuugccaguaacaaaacuauugagugugcgugccgagauaauucuuacacagccaagagacccuucgugaaacucaacgucgaaaccgacacugcagagauaaggcugaugugcacaaagaccuauuuagauacgccucggccaaaugacggcuccaucaccggccccugugagagcgauggggacgaaggaucggguggcauuaaagggggauuugugcaucaacguauggcuucuaagaucggccgcugguacuccagaacaaugucaaaaacuaagaggauggguauggggcuguauguaaaguacgacggcgauccguggaccgacagugaggcccucgcucuuagcggaguuaugguguccauggaggaaccuggcugguacucuuucggguuugaaauaaaagauaagaaaugcgacguccccuguauuggaaucgagauggugcacgaugguggcaagacaacuuggcauagcgccgcaaccacaaucuauugccugauggggucaggacaguugcuaugggacaccgugacuggcgucaacauuacgcuguga

SEQ ID NO: 152486 - RNA, 1401 nt, Artificial Sequence; identical to SEQ ID NO: 152485
  derived and/or modified sequence opt3 from neuraminidase__InfluenzaB__EPI551248

SEQ ID NO: 152487 - RNA, 1401 nt, Artificial Sequence; identical to SEQ ID NO: 152485
  derived and/or modified sequence opt3 from neuraminidase__InfluenzaB__EPI544258

SEQ ID NO: 152488 - RNA, 1401 nt, Artificial Sequence; identical to SEQ ID NO: 152390
  derived and/or modified sequence opt3 from neuraminidase__InfluenzaB__EPI592698

SEQ ID NO: 152489 - RNA, 1401 nt, Artificial Sequence; identical to SEQ ID NO: 152390
  derived and/or modified sequence opt3 from neuraminidase__InfluenzaB__EPI592706

SEQ ID NO: 152490 - RNA, 1401 nt, Artificial Sequence
  derived and/or modified sequence opt3 from neuraminidase__InfluenzaB__EPI693093
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggagucuaagaucggccgcugguacuccagaacaaugucaaaaacuaagaggauggguauggggcuguauguuaaguacgacggcgauccguggaccgacagugaagcacucgcucuuagcggagugauggucuccauggaggaaccuggcugguacucuuucggguuugagauaaaagauaagaaaugcgacgugcccuguauuggaaucgagauggugcacgaugguggcaagacaacuuggcauagcgccgcuaccgccaucuauugccugauggggucaggacaguugcuaugggacacagucaccggcguuaacaugacucuguga

SEQ ID NO: 152491 - RNA, 1401 nt, Artificial Sequence
  derived and/or modified sequence opt3 from neuraminidase__InfluenzaB__EPI678795
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaguaacauuccuccugcccgaaccugaguggaccuauccaaggcugagcugucccgguaguacuuuucagaaggcccucuuaaucuccccucaccgguucggcgaaacaaaaggaaauucugcaccacugauuauccgcgagcccuuuguggccugcgggccuaacgaauguaagcauuucgcucuuacccacuacgcagcccagccaggcgguuauuacaaugggacgcgaggagaccguaacaaauugagacaucugauuagcgucaagcuaggcaagaucccgacuguggaaaauuccauauuucacauggcugccuggucaggcagugcgugccaugaugggaaagaguggaccuauaucggaguugacggucccgauaacaaugcacuccugaaggugaaauacggcgaggccuacacagacacuuaucacagcuacgcuaacaauauucuuaggacccaggagucugccuguaacugcaucgggggaaauuguuaucugaugauuacagauggcuccgcaucaggugucagcgaaugccgguucuugaagauccgcgaggggagaauaauuaaagagaucuuuccuaccggaagggugaagcacacggaagaguguacuugcggcuucgcuaguaacaagacaauugaaugugccugccgggacaaucgcuacaccgcgaaacgaccauuuguaaagcucaacguugagacugauacagccgaaaucagacugaugugcaccgacacguauuuagauacccccaggccuaacgacggcucuaucacagggccaugugaguccgauggagacaaagguagcggcgggauuaagggaggcuucgugcaucaacggaugaaaucgaagauaggucguugguacucucgcacuauguccaaaaccgagagaauggggaugggccuguaugucaaguacggaggcaaucccugggcagacucagaugcucucacauuuaguggggugauggugagcaugaaggaaccgggaugguacuccuucgguuucgagaucaaagacaagaaaugcgaugucccuuguauuggcaucgaaaugguucacgacgggggaaaggagacuuggcauucugccgcuaccgccauauauugccuuaugggcagcggucagcuguugugggauacagugaccgggguagacauggcacuauga

SEQ ID NO: 152492 - RNA, 1401 nt, Artificial Sequence; identical to SEQ ID NO: 152491
  derived and/or modified sequence opt3 from neuraminidase__InfluenzaB__EPI721063

SEQ ID NO: 152493 - RNA, 1401 nt, Artificial Sequence; identical to SEQ ID NO: 150911
  derived and/or modified sequence opt3 from neuraminidase__InfluenzaB__EPI328903

SEQ ID NO: 152494 - RNA, 1401 nt, Artificial Sequence
  derived and/or modified sequence opt3 from neuraminidase__InfluenzaB__EPI543192
augcugcccagcaccauccagacacucacucuuuuccugacguccggcgggguguuguuaucucuguacgucucagccagucuaagcuaucuccuguaccuugacauucuguugaaguuuccuuccaccgagauaacagcuccaacuaugccgcucgauugcgcaaacgccucuaauguucaagcggugaacagaucggcuaccaaaggaguaacacugcugcuccccgaaccugaguggaccuauccaagguuaucaugucccgguagcacuuuccagaaggcccugcuuaucaguccucaccgguuuggcgaaacaaaaggaaauuccgcaccauugauuauccgcgagcccuucauugccugcgggccuaaggaauguaaacauuuugcucugacccacuacgcagcccagccaggcgguuauuacaacgggacgcgaggagaccguaauaagcuaagacaucucaucucugugaagcugggcaaaauaccgacugucgagaacagcaucuuccacauggcugccugguccggcucagcgugccaugaugggaaggaguggaccuauauuggaguggacggucccgauaauaacgcacuucugaaaaucaaguacggcgaagccuacacagacacuuaucacaguuacgcuaauaacauuuugaggacccaggagagcgccuguaauugcaucgggggaaacuguuaucucaugauaacagauggcucugcauccgguguuucagaaugccgguuucugaaaauucgcgaggggagaaucaugaaggagauuuucccuaccggaaggacgcaacacacugaagaguguacaugcggcuuugcuagcaauaagaccaucgaaugugccugccgggacaacaguuacacugcgaaacgcccauucgugaaguuaaaugucgagacagauaccgccgaaauccgacugaugugcacgaaaaccuaucucgacacacccagaccugaugacggcucuauuacugggccaugugaguccaacggagguaagggcagcgggggaauaaaaggcgguuuugugcaucagaggauggcaucgaagaucgggcggugguacucucguaccauguccaaaacagagcgcaagggcaugggacuuuauauuaaguacaacggcgaucccugggcugacucagacgcccugacuuucagugggguaaugguuagcauggaggaaccgggaugguacuccuuugguuucgaaaucaaagauaagaaaugcgacgugccuuguauaggcauugagaugguccacgaugggggaaaggaaaccuggcauucugcugccacagcaaucuauugcuugaugggcagcggucagcuacugugggacaccgugacuggggugaauaugacgcucuga

SEQ ID NO: 152495 - RNA, 1401 nt, Artificial Sequence; identical to SEQ ID NO: 152494
  derived and/or modified sequence opt3 from neuraminidase__InfluenzaB__EPI500360

SEQ ID NO: 152496 - RNA, 1401 nt, Artificial Sequence
  derived and/or modified sequence opt3 from neuraminidase__InfluenzaB__EPI543186
augcugcccagcaccauccagacacucacucuuuuccugacguccggcgggguguuguuaucucuguacgucucagccagucuaagcuaucuccuguacuccgacauucuucugaaguuuucuagaaccgagguuacagcuccuauaaugccauuggauugcgcaaacgccucgaaugugcaagcgguaaacaggucagcuacuaaaggagugaccccgcuccugcccgaaccugaguggacauauccacggcugagcugucccgguaguaccuuccagaaggcccucuuaaucuccccucaccgcuuuggcgaaacuaaaggaaauucugcaccacugauuauccgagagcccuucauugccugcgggccuaaggaauguaaacauuuugcucuuacacacuacgcagcccagccaggcgguuauuacaacgggacccgugaggacagaaauaaguugaggcaucugaucagcgucaagcuaggaaaaauaccgacgguggagaacuccaucuuccacauggcugccuggucaggcagugcgugccaugauggccgggaauggacuuauauugggguugacggacccgauagcaaugcacuccugaagaucaaauacggugaggccuacaccgacacauaucacucuuacgcuaagaacauucuucgcacucaggaauccgccuguaauugcaucggcggggauuguuaucugaugauaaccgacggaccugcaucaggcauuagcgagugcagauuuuugaaaaucagggagggucggauuaucaaggaaaucuucccaacagggcgcgugaagcacaccgaggaauguacgugcggauuugcuaguaacaaaacuauugagugugccugccgagauaauucuuacacagcgaagagacccuucgucaaacucaacguggaaaccgacacugccgagauaaggcugaugugcacaaagaccuauuuagauacgccucggccaaaugacggcuccaucaccggccccugugagagcgauggggacgaaggaucggguggcauuaaagggggauuuguacaucaacguauggcaucuaagaucggccgcugguacuccagaacaaugucaaaaacuaagaggauggguauggggcuguauguuaaguacgacggcgauccguggaccgacagugaggcucucgcccuuagcggagugauggucuccauggaggaaccuggcugguacucuuucggguuugaaauaaaagauaagaaaugcgacgugcccuguauuggaaucgagauggugcacgaugguggcaagacaacuuggcauagcgcugccaccgucaucuauugccugauggggucaggacaguugcuaugggacacaguuaccggcgugaacaugacucuguga

SEQ ID NO: 152497 - RNA, 1401 nt, Artificial Sequence; identical to SEQ ID NO: 152496
  derived and/or modified sequence opt3 from neuraminidase__InfluenzaB__EPI536448

SEQ ID NO: 152498 - RNA, 1401 nt, Artificial Sequence
  derived and/or modified sequence opt3 from neuraminidase__InfluenzaB__NP_056663
augcugcccagcaccgugcagacacucacucuucuguugacguccggcggggucuuacugucucuauacguuucagccagucucagcuaucugcuuuacuccgacgugcuguugaaguucucuucgaccaaaacaacugcuccuaccaugucacucgagugcacaaacgcaagcaaugcccaaaccguaaaccacagugcgacuaaggaaaugacauuuccaccgcccgagccugaauggaccuauccaagacuguccugucagggaucuacguuccagaaagcucugcucaucagcccccauagguuuggugagauuaagggcaauuccgccccuuuaauaauccgggaaccauucguggcaugcgggcccaaagagugucgccacuuugcccugacucauuacgcugcacagccuggaggcuauuacaacgguacccgaaaggaucguaauaaacuuagacacuuggucucagugaagcuggggaagauuccaacaguugagaacaguaucuuccauauggccgcuuggagcggaucugccugccacgacggcagggaauggacuuauauuggcguggaugggccggacaaugaugcgcuagucaaaaucaaguacggagaggcauacaccgacacauaucacuccuacgcccauaacauacuccggacccaagaaucagcuuguaauugcaucgguggcgauuguuaucugaugauuacggacgggagcgccaguggaaucucuaaaugccgcuuucuuaagauuagagagggcaggaucauaaaggagauucugcccacuggucggguggaacacacagaggaauguaccugcggguucgcauccaacaaaacuaucgagugugcuugccgcgauaauagcuacacagccaagcgaccuuuuguaaaauugaacguugaaaccgacacggcggagauuagacucaugugcaccaagacauaucuggauacuccaaggcccgacgauggaucgaucgccggcccuugugagucuaauggcgacaaaugguuagggggaaucaaggguggcuucgugcaucagcggauggcauccaaaauugggcguugguacucacgcaccaugaguaagacaaacagaaugggaauggaacuguaugucaaguacgacggcgauccauggacugacagcgaugcucucacccuuuccggugugauggugucuauagaggaacccgggugguacagcuuuggcuucgagaucaaagacaagaaaugcgaugucccguguauuggaaucgaaaugguucacgacggcgggaaggauacauggcacucagccgcuaccgccauauauugccugaugggaaguggucaguugcuaugggacacugugacgggcguagauauggcacuguga

SEQ ID NO: 152499 - RNA, 1401 nt, Artificial Sequence
  derived and/or modified sequence opt3 from neuraminidase__InfluenzaB__ABG85180
augcugcccagcaccgugcagacacucacucuucuguugacguccggcggggucuuacugucucuauacguuucagccagucucagcuaucugcuuuacuccgacgugcuguugaaguucucuucgaccaaaacaacugcuccuaccaugucacucgagugcacaaacgcaagcaaugcccaaaccguaaacuauagugcgacuaaggaaaugacauuuccaccgcccgagccugaauggaccuacccaagacuguccugucagggaucuacguuccagaaagcucugcucaucagcccccacagguuuggugagauuaagggcaauuccgccccuuuaauaauccgggaaccauucguggcaugcgggcccaaagagugucgccauuuugcccugacucacuaugcugcacagccuggaggcuacuaucaugguacccgaaaggaucguaacaaacuuagacacuuggucucagugaagcuggggaagauuccaacaguugagaauaguaucuuccauauggccgcuuggagcggaucugccugccacgacggcagggaauggacuuacauuggcguggaugggccggacaacgaugcgcuagucaaaaucaaguacggagaggcauauaccgacacauaccacuccuaugcccauaauauacuccggacccaagaaucagcuuguaacugcaucgguggcgauuguuaccugaugauuacggacgggagcgccaguggaaucucuaaaugccgcuuucuuaagauuagagagggcaggaucauaaaggagauucugcccacuggucggguggaacacacagaggaauguaccugcggguucgcauccaauaaaacuaucgagugugcuugccgcgauaacagcuauacagccaagcgaccuuuuguaaaauugaauguugaaaccgacacggcggagauuagacucaugugcaccaagacauaccuggauacuccaaggcccgacgauggaucgaucgccggcccuugugagucuaacggcgacaaaggguuaggagguaucaagggcggguucgugcaucagcggauggcauuuaaaauuggacguugguauucccgcaccaugucaaagacaaauagaaugggcauggaacuguacgucaaguacgacggugauccauggacugacagugaugcucucacccuuagcggggugaugguguccauagaggaacccggcugguauucuuucggauuugagaucaaagacaagaaaugcgaugucccguguauuggcaucgaaaugguucacgacgggggagaggauacauggcacagcgccgcuaccgccauauacugccugauggguucaggccaguugcuaugggacacugugacggggauugauauggcacuguga

SEQ ID NO: 152500 - RNA, 1401 nt, Artificial Sequence; identical to SEQ ID NO: 152389
  derived and/or modified sequence opt3 from neuraminidase__InfluenzaB__EPI376345

SEQ ID NO: 152501 - RNA, 1401 nt, Artificial Sequence; identical to SEQ ID NO: 152389
  derived and/or modified sequence opt3 from neuraminidase__InfluenzaB__EPI368424

SEQ ID NO: 152502 - RNA, 1401 nt, Artificial Sequence
  derived and/or modified sequence opt3 from neuraminidase__InfluenzaB__EPI331150
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcgaugaacagaucagcuaccaaaggagugacacuccugcugcccgaaccugaguggaccuauccaaggcucagcugucccgguaguacuuuccagaaggccuuacugaucuccccucaccgguuuggcgaaacaaaaggaaauucugcaccacuuauuauccgcgagcccuucauugccugcgggccuaacgaauguaagcauuuugcuuugacccacuacgcagcccagccaggcgguuauuacaaugggacgcgaggagaccguaacaaacugagacaucuaaucagcguaaagcucggcaagauaccgacuguggaaaauuccaucuuccacauggcugccuggucaggcagugcgugccaugaugggaaagaguggaccuauauuggagucgacggucccgauaacaaugcacugcuuaaggugaaauacggcgaggccuacacagacacuuaucacagcuacgcuaacaagauccugaggacccaggagucugccuguaauugcauugggggaaacuguuauuugaugaucacagauggcuccgcaucagguguuagcgaaugccgguuucucaaaauacgcgaggggagaauuaucaaggagauuuucccuaccggaagggugaagcacacggaagaguguacuugcggcuuugcuaguaauaaaacaaucgaaugugccugccgggacaacucuuacaccgcgaagcgcccauucgucaaacugaauguggagacugauacagccgaaauccgauuaaugugcaccgacacguaucuggauacccccagaccuaacgacggcuccauuacagggccaugugagagcgauggagacaaggguucgggcgggauaaaaggaggcuuuguacaucaaaggauggagucuaagaucggucggugguacucccguacuaugucaaaaaccgaacgcauggggaugggccucuauguuaaguacgacggagaucccugggcagacagugaugcucuugccuucagcggcgugauggucuccaugaaggagccggggugguacucuuuuggauucgaaauuaaagacaagaaaugcgaugugccuuguaucgguauagagauggugcacgacggcgggaaggaaacauggcauagcgcugccacugcaauuuauugccugaugggaucaggccaguugcuaugggauaccgucacagguguugacauggcccuguga

SEQ ID NO: 152503 - RNA, 1401 nt, Artificial Sequence; identical to SEQ ID NO: 152502
  derived and/or modified sequence opt3 from neuraminidase__InfluenzaB__EPI358089

SEQ ID NO: 152504 - RNA, 1401 nt, Artificial Sequence; identical to SEQ ID NO: 150648
  derived and/or modified sequence opt3 from neuraminidase__InfluenzaB__ABL76698

SEQ ID NO: 152505 - RNA, 1401 nt, Artificial Sequence
  derived and/or modified sequence opt3 from neuraminidase__InfluenzaB__AAD42328
augcugcccagcaccauccagacacucacucuuuuccugacguccggcgggguguuguuaucucuguacgucucagccagucuaagcuaucuccuguacuccgacauucuucugaaguuuucuccuaccgagauaacagcuccaacuaugccguuggauugcgcaaacgccucgaauguucaagcggugaacagaucagcuaccaaaggaaugacacuccugcugcccgaaccugaguggaccuauccaaggcucagcugucccgguaguacuuuccagaaggccuuacugaucuccccucaccgguuuggcgaaacacgcggaaauucugcaccacuuaccauucgagagcccuucaucgccugcgggccuaaagaauguaagcauuuugcuuugacgcacuacgcagcccagccaggcgguuauuacaacgggacucgugaggacagaaauaaacugaggcaucuaauuagcguaaagcucggaaagaucccgaccguggagaacuccauauuccacauggcugccuggucaggcagugcgugccaugauggccgggaauggacauauaucggggucgacggacccgauagcaaugcacugauuaaaaucaaguacggugaggccuacacugacaccuaucacucuuacgcuaacaauauucuucgcacacaggaauccgccuguaacugcaucggcggggauuguuaucugaugauaaccgacggaucagcaagcggcauuaguaaaugcagauuuuugaagaucagggagggucggauuaucaaagagaucuucccuacggggcgcguggaacacacugaggaauguacaugcggauuugcuucuaauaagaccauugagugugccugccgagauaacuccuacacugcgaagagaccauucguuaaacucaauguggaaacagacaccgccgagauaaggcugaugugcacggagaccuauuuagauacaccccggccugacgauggcagcaucacuggcccaugugaaucgaacggggacaagggacgugguggcauuaaagggggauuuguccaucaacgcauggcaucuaagaucggcagaugguacuccaggaccaugucaaaaacaaagcggauggguauggagcuguaugugaaauacgacggggaucccuggauagacagugaugcucucgccccgagcggcguaaugguuuccauggaggaaccuggaugguacucuuucggcuuugaaauuaaggacaagaaaugcgaugugcccuguaucgggaucgagaugguccacgacggagguaagaaaacuuggcauagcgcugccaccgcaauuuauugccuuaugggcucagggcagcuguugugggauacagugaccggaguggaccgaagugucuga

SEQ ID NO: 152506 - RNA, 1401 nt, Artificial Sequence; identical to SEQ ID NO: 152191
  derived and/or modified sequence opt3 from neuraminidase__InfluenzaB__EPI541349

SEQ ID NO: 152507 - RNA, 1401 nt, Artificial Sequence; identical to SEQ ID NO: 152390
  derived and/or modified sequence opt3 from neuraminidase__InfluenzaB__EPI541759

SEQ ID NO: 152508 - RNA, 1401 nt, Artificial Sequence; identical to SEQ ID NO: 152483
  derived and/or modified sequence opt3 from neuraminidase__InfluenzaB__EPI826201

SEQ ID NO: 152509 - RNA, 1401 nt, Artificial Sequence; identical to SEQ ID NO: 152222
  derived and/or modified sequence opt3 from neuraminidase__InfluenzaB__EPI477398

SEQ ID NO: 152510 - RNA, 1401 nt, Artificial Sequence; identical to SEQ ID NO: 152222
  derived and/or modified sequence opt3 from neuraminidase__InfluenzaB__EPI492570

SEQ ID NO: 152511 - RNA, 1401 nt, Artificial Sequence; identical to SEQ ID NO: 152222
  derived and/or modified sequence opt3 from neuraminidase__InfluenzaB__EPI498339

SEQ ID NO: 152512 - RNA, 1401 nt, Artificial Sequence; identical to SEQ ID NO: 152443
  derived and/or modified sequence opt3 from neuraminidase__InfluenzaB__EPI538118

SEQ ID NO: 152513 - RNA, 1401 nt, Artificial Sequence; identical to SEQ ID NO: 152443
  derived and/or modified sequence opt3 from neuraminidase__InfluenzaB__EPI538124

SEQ ID NO: 152514 - RNA, 1401 nt, Artificial Sequence; identical to SEQ ID NO: 152443
  derived and/or modified sequence opt3 from neuraminidase__InfluenzaB__EPI556421

SEQ ID NO: 152515 - RNA, 1401 nt, Artificial Sequence; identical to SEQ ID NO: 152443
  derived and/or modified sequence opt3 from neuraminidase__InfluenzaB__EPI614609

SEQ ID NO: 152516 - RNA, 1401 nt, Artificial Sequence; identical to SEQ ID NO: 150687
  derived and/or modified sequence opt3 from neuraminidase__InfluenzaB__BAB32609

SEQ ID NO: 152517 - RNA, 1401 nt, Artificial Sequence; identical to SEQ ID NO: 150833
  derived and/or modified sequence opt3 from neuraminidase__InfluenzaB__EPI271544

SEQ ID NO: 152518 - RNA, 1401 nt, Artificial Sequence; identical to SEQ ID NO: 150833
  derived and/or modified sequence opt3 from neuraminidase__InfluenzaB__AFH57957

SEQ ID NO: 152519 - RNA, 1401 nt, Artificial Sequence; identical to SEQ ID NO: 150833
  derived and/or modified sequence opt3 from neuraminidase__InfluenzaB__EPI294881

SEQ ID NO: 152520 - RNA, 1401 nt, Artificial Sequence; identical to SEQ ID NO: 150688
  derived and/or modified sequence opt3 from neuraminidase__InfluenzaB__ABL77259

SEQ ID NO: 152521 - RNA, 1701 nt, Artificial Sequence
  derived and/or modified sequence opt4 from hemagglutinin__InfluenzaA__AAA16879
auggaggccaagcuguucgugcuguucugcaccuucaccgugcugaaggccgacaccaucugcgugggcuaccacgccaacaacagcaccgacaccguggacaccgugcuggagaagaacgugaccgugacccacagcgugaaccugcuggaggacagccacaacggcaagcugugcagccugaacggcaucgccccccugcagcugggcaagugcaacguggccggcuggcugcugggcaaccccgagugcgaccugcugcugaccgccaacagcuggagcuacaucaucgagaccagcaacagcgagaacggcaccugcuaccccggcgaguucaucgacuacgaggagcugagagagcagcugagcagcgugagcagcuucgagaaguucgagaucuuccccaaggccagcagcuggcccaaccacgagaccaccaagggcgugaccgccgccugcagcuacagcggcgccagcagcuucuacagaaaccugcuguggaucaccaagaagggcaccagcuaccccaagcugagcaagagcuacaccaacaacaagggcaaggaggugcuggugcuguggggcgugcaccacccccccaccaccagcgagcagcagagccuguaccagaacgccgacgccuacgugagcgugggcagcagcaaguacaacagaagauucacccccgagaucgccgccagacccaaggugagaggccaggccggcagaaugaacuacuacuggacccugcuggaccagggcgacaccaucaccuucgaggccaccggcaaccugaucgcccccugguacgccuucgcccugaacaagggcagcgacagcggcaucaucaccagcgacgcccccgugcacaacugcgacaccagaugccagaccccccacggcgcccugaacagcagccugcccuuccagaacgugcaccccaucaccaucggcgagugccccaaguacaucaagagcaccaagcugagaauggccaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaaccuggagagaagaaucgagaaccugaacaagaagguggacgacggcuuccuggacguguggaccuacaacgccgagcugcuggugcugcuggagaacgagagaacccuggacuuccacgacagcaacgugagaaaccuguacgagaaggugaagagccagcugagaaacaacgccaaggagcugggcaacggcugcuucgaguucuaccacaagugcgacgacgagugcauggagagagagaagaacggcaccuacgacuaccccaaguacagcgaggagagcaagcugaacagagaggagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152522 - RNA, 1701 nt, Artificial Sequence
  derived and/or modified sequence opt4 from hemagglutinin__InfluenzaA__AAA16880
auggaggccaagcuguucgugcuguucugcaccuucaccgugcugaaggccgacaccaucugcgugggcuaccacgccaacaacagcaccgacaccguggacaccgugcuggagaagaacgugaccgugacccacagcgugaaccugcuggaggacagccacaacggcaagcugugcagccugaacggcaucgccccccugcagcugggcaagugcaacguggccggcuggcugcugggcaaccccgagugcgaccugcugcugaccgccaacagcuggagcuacaucaucgagaccagcaacagcgagaacggcaccugcuaccccggcgaguucaucgacuacgaggagcugagagagcagcugagcagcgugagcagcuucgagaaguucgagaucuuccccaaggccagcagcuggcccaaccacgagaccaccaagggcgugaccgccgccugcagcuacagcggcgccagcagcuucuacagaaaccugcuguggaucaccaagaagggcaccagcuaccccacccugagcaagagcuacaccaacaacaagggcaaggaggugcuggugcuguggggcgugcaccacccccccaccgugaacgagcagcagagccuguaccagaacgccgacgccuacgugagcgugggcagcagcaaguacaacagaagauucacccccgagaucgccgccagacccaaggugagaggccaggccggcagaaugaacuaccacuggacccugcuggaccagggcgacaccaucaccuucgaggccaccggcaaccugaucgcccccugguacgccuucgcccugaacaagggcagcgacagcggcaucaucaccagcgacgcccccgugcacaacugcgacaccagaugccagaccccccacggcgcccugaacagcagccugcccuuccagaacgugcaccccaucaccaucggcgagugccccaaguacgugaagagcaccaagcugagaauggccaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacaccaaguucaccgccgugggcaaggaguucaacaaccuggagagaagaaucgagaaccugaacaagaagguggacgacggcuuccuggacguguggaccuacaacgccgagcugcuggugcugcuggagaacgagagaacccuggacuuccacgacagcaacgugagaaaccuguacgagaaggugaagagccagcugagaaacaacgccaaggagcugggcaacggcugcuucgaguucuaccacaagugcgacgacgagugcaucgagagcgugaagaacggcaccuacgacuaccccaaguacagcgaggagagcaagcugaacagagaggagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152523 - RNA, 1689 nt, Artificial Sequence
  derived and/or modified sequence opt4 from hemagglutinin__InfluenzaA__AAA64362
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaaguaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcgacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgagaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccagauacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 152524 - RNA, 1689 nt, Artificial Sequence
  derived and/or modified sequence opt4 from hemagglutinin__InfluenzaA__AAA64363
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccagggcggcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaucaacacccaguucgaggccguggagaaggaguucagcaaccuggagagaagacuggagaaccugaacaagaagauggaggacggcuuccuggacguguggaccuacaacgccgagcugcuggugcugauggagaacgagagaacccuggacuuccacgacagcagcgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcaucuaccagauccuggccaucuacgccaccguggccggcagccugagccuggccaucaugauggccggcaucagcuucuggaugugcagcaacggcagccugcagugcagaaucugcaucuga

SEQ ID NO: 152525 - RNA, 1689 nt, Artificial Sequence
  derived and/or modified sequence opt4 from hemagglutinin__InfluenzaA__AAA64365
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaagggcagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaagguggacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccugggcaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccguggagaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacaacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcaucuaccagauccuggccaucuacgccaccguggccggcagccugagccuggccaucaugauggccggcaucagcuucuggaugugcagcaacggcagccugcagugcagaaucugcaucuga

SEQ ID NO: 152526 - RNA, 1689 nt, Artificial Sequence
  derived and/or modified sequence opt4 from hemagglutinin__InfluenzaA__AAA64366
auggccaucaucuaccugauccugcuguucaccgccgugagaggcgaccagaucugcaucggcuaccacgccaacaacagcaccgagaagguggacaccauccuggagagaaacgugaccgugacccacgccaaggacauccuggagaagacccacaacggcaagcugugcaagcugaacggcauccccccccuggagcugggcgacugcagcaucgccggcuggcugcugggcaaccccgagugcgacagacugcugagcgugcccgaguggagcuacaucauggagaaggagaaccccagagacggccugugcuaccccggcagcuucaacgacuacgaggagcugaagcaccugcugagcagcgugaagcacuucgagaaggugaagauccugcccaaggacagauggacccagcacaccaccaccggcggcagcagagccugcgccgugagcggcaaccccagcuucuucagaaacaugguguggcugaccaagaaggagagcaacuaccccguggccaagggcagcuacaacaacaccagcggcgagcagaugcugaucaucuggggcgugcaccaccccaacgacgagaccgagcagagaacccuguaccagaacgugggcaccuacgugagcgugggcaccagcacccugaacaagagaagcacccccgacaucgccaccagacccaaggugaacggccugggcagcagaauggaguucagcuggacccugcuggacaugugggacaccaucaacuucgagagcaccggcaaccugaucgcccccgaguacggcuucaagaucagcaagagaggcagcagcggcaucaugaagaccgagggcacccuggagaacugcgagaccaagugccagaccccccugggcgccaucaacaccacccugcccuuccacaacgugcacccccugaccaucggcgagugccccaaguacgugaagagcgagaagcuggugcuggccaccggccugagaaacgugccccagaucgagagcagaggccuguucggcgccaucgccggcuucaucgagggcggcuggcagggcaugguggacggcugguacggcuaccaccacagcaacgaccagggcagcggcuacgccgccgacaaggagagcacccagaaggccuucgacggcaucaccaacaaggugaacagcgugaucgagaagaugaacacccaguucgaggccgugggcaaggaguucagcaaccuggagagaagacuggagaaccugaacaagaagauggaggacggcuuccuggacguguggaccuacaacgccgagcugcuggugcugauggagaacgagagaacccuggacuuccacgacagcaacgugaagaaccuguacgacaaggugagaaugcagcugagagacaacgugaaggagcugggcaacggcugcuucgaguucuaccacaagugcgacgacgagugcaugaacagcgugaagaacggcaccuacgacuaccccaaguacgaggaggagagcaagcugaacagaaacgagaucaagggcgugaagcugagcagcaugggcguguaccagauccuggccaucuacgccaccguggccggcagccugagccuggccaucaugauggccggcaucagcuucuggaugugcagcaacggcagccugcagugcagaaucugcaucuga

SEQ ID NO: 152527 - RNA, 1701 nt, Artificial Sequence
  derived and/or modified sequence opt4 from hemagglutinin__InfluenzaA__AAA85781
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccaaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuacaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaucagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaaccccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152528 - RNA, 1707 nt, Artificial Sequence
  derived and/or modified sequence opt4 from hemagglutinin__InfluenzaA__AAC14418
auggagagaaucgugcugcugcuggccaccgugagccuggugaagagcgaccagaucugcaucggcuaccacgccaacaacagcaccgagcagguggacaccaucauggagaagaacgugaccgugacccacgcccaggacauccuggagagaacccacaacggcaagcugugcgaccugaacggcgugaagccccugauccugagagacugcagcguggccggcuggcugcugggcaaccccaugugcgacgaguucaucaacgugcccgaguggagcuacaucguggagaaggccagccccgccaacgaccugugcuaccccggcaacuucaacgacuacgaggagcugaagcaccugcugagcagaaucaaccacuucgagaagauccagaucauccccaagagcagcuggagcaaccacgacgccagcagcggcgugagcagcgccugccccuaccugggcagaagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccgagaucgccaccagacccaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacgccccccagagagagagaagaagaaagaagagaggccuguucggcgccaucgccggcuucaucgagggcggcuggcagggcaugguggacggcugguacggcuaccaccacagcaacgagcagggcagcggcuacgccgccgaccaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaugggcaccuaccagauccugagcaucuacagcaccguggccagcagccuggcccuggccaucaugguggccggccugagccuguggaugugcagcaacggcagccugcagugcagaaucugcaucuga

SEQ ID NO: 152529 - RNA, 1707 nt, Artificial Sequence
  derived and/or modified sequence opt4 from hemagglutinin__InfluenzaA__AAC40508
auggagagaaccgugcugcugcuggccaccgugagccuggugaagagcgaccagaucugcaucggcuaccacgccaacaacagcaccgagcagguggacaccaucauggagaagaacgugaccgugacccacgcccaggacauccuggagagaacccacaacggcaagcugugcgaccugaacggcgugaagccccugauccugagagacugcagcguggccggcuggcugcugggcaaccccaugugcgacgaguucaucaacgugcccgaguggagcuacaucguggagaaggccagccccgccaacgaccugugcuaccccggcaacuucaacgacuacgaggagcugaagcaccugcugagcagaaucaaccacuucgagaagauccagaucauccccaagagcagcuggagcaaccacgacgccagcagcggcgugagcagcgccugccccuaccugggcagaagcagcuucuucagaaacgugguguggcugaucaagaagaacagcgccuaccccaccaucaagagaagcuacaacaacaccaaccaggaggaccugcuggugcuguggggcgugcaccaccccaacgacgccgccgagcagaccaagcuguaccagaaccccaccaccuacaucagcgugggcaccagcacccugaaccagagacuggugcccgagaucgccaccagacccaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacaccccccagagagagagaagaagaaagaagagaggccuguucggcgccaucgccggcuucaucgagggcggcuggcagggcaugguggacggcugguacggcuaccaccacagcaacgagcagggcagcugcuacagcgccgacaaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaugggcaccuaccagauccugagcaucuacagcaccguggccagcagccuggcccuggccaucaugguggccggccugagccuguggaugugcagcaacggcagccugcagugcagaaucugcaucuga

SEQ ID NO: 152530 - RNA, 1701 nt, Artificial Sequence
  derived and/or modified sequence opt4 from hemagglutinin__InfluenzaA__AAF87274
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugaagggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccaacagcuggcccaaccacgagaccaacagaggcgugaccagcgccugccccuacgccggcgccaacagcuucuacagaaaccugaucuggcuggugaagaagggcaacagcuaccccaagcugagcaagagcuacaucaacaacaagggcaaggaggugcuggugcuguggggcauccaccacccccccaccagcaacgaccagcagagccuguaccagaacgccgacgccuacguguucgugggcagcagcaaguacaacaagaaguucaugcccgagaucgccaccagacccaaggugagaggccaggccggcagaaugaacuacuacuggacccugaucgagcccggcgacaccaucaccuucgaggccaccggcaaccugguggcccccagauacgccuucgccauggagagaggcagcggcagcggcaucaucaucagcgacacccccgugcacgacugcaacgccaccugccagacccccaagggcgccaucaacaccaaccugcccuuccagaacauccaccccgugaccaucggcgagugccccaaguacgugaagagcaccagacugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucaagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugagaaacaacgccaaggagaucggcaacggcugcuucgaguucuaccacaagugcgacgacaccugcauggagagcaucaagaacggcaccuacgacuaccccaaguacagcgaggaggccaagcugaccagagaggagaucgacggcgugaagcuggagagcaccagaaucuaccagauccuggccaucuacagcaccaucgccagcagccuggugcugcuggugagccugggcgccaucagcuucuggaugugcagcaacggcagccugcagugcagaaucugcaucuga

SEQ ID NO: 152531 - RNA, 1701 nt, Artificial Sequence
  derived and/or modified sequence opt4 from hemagglutinin__InfluenzaA__AAF87275
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggagaacagacacaacggcaagcugugcaagcugaagggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccaacagcuggcccaaccacgagaccaacagaggcgugaccagcgccugccccuacgccggcgccaacagcuucuacagaaaccugaucuggcuggugaagaagggcaacagcuaccccaagcugagcaagagcuacaucaacaacaagggcaaggaggugcuggugcuguggggcauccaccacccccccaccagcaacgaccagcagagccuguaccagaacgccgacgccuacguguucgugggcagcagcaaguacaacaagaaguucaugcccgagaucgccaccagacccaaggugagaggccaggccggcagaaugaacuacuacuggacccugaucgagcccggcgacaccaucaccuucgaggccaccggcaaccugguggcccccagauacgccuucgccauggagagaggcagcggcagcggcaucaucaucagcgacacccccgugcacgacugcaacgccaccugccagacccccaagggcgccaucaacaccaaccugcccuuccagaacauccaccccgugaccaucggcgagugccccaaguacgugaagagcaccagacugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugagaaacaacgccaaggagaucggcaacggcugcuucgaguucuaccacaagugcgacgacaccugcauggagagcaucaagaacggcaccuacgacuaccccaaguacagcgaggaggccaagcugaccagagaggagaucgacggcgugaagcuggagagcaccagaaucuaccagauccuggccaucuacagcaccaucgccagcagccuggugcugcuggugagccugggcgccaucagcuucuggaugugcagcaacggcagccugcagugcagaaucugcaucuga

SEQ ID NO: 152532 - RNA, 1701 nt, Artificial Sequence
  derived and/or modified sequence opt4 from hemagglutinin__InfluenzaA__AAF87277
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcaucgccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccgaccacgagaccaacagaggcgugaccgccgccugccccuacgccggcgccaacagcuucuacagaaaccugaucuggcuggugaagaagggcaacagcuaccccaagcugagcaagagcuacaucaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccagcagacccaaggugagaggccaggccggcagaauggacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcgugaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccugauccugcuggugagccugggcgccaucagcuucuggaugugcagcaacggcagccugcagugcagaaucugcaucuga

SEQ ID NO: 152533 - RNA, 1701 nt, Artificial Sequence
  derived and/or modified sequence opt4 from hemagglutinin__InfluenzaA__AAF87278
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcaucgccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacaucaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccagcagacccaaggugagaggccaggccggcagaauggacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcgugaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagagcccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccugauccugcuggugagccugggcgccaucagcuucuggaugugcagcaacggcagccugcagugcagaaucugcaucuga

SEQ ID NO: 152534 - RNA, 1701 nt, Artificial Sequence
  derived and/or modified sequence opt4 from hemagglutinin__InfluenzaA__AAF87279
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcaucgccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccgccgccugccccuacgccggcgccaacagcuucuacagaaaccugaucuggcuggugaagaagggcaacagcuaccccaagcugagcaagagcuacaucaacaacaaggagaaggaggugcuggugcuguggggcauccaccacccccccaccagcaccgaccagcagagccuguaccagaacgccgacgccuacguguucgugggcagcagcaaguacaacaagaaguucaagcccgagaucgccagcagacccaaggugagaggccaggccggcagaauggacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcgugaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggagagcaagcugaacagagaggagaucgacggcgugaagcuggagagcaccagaaucuaccagauccuggccaucuacagcaccguggccagcagccugauccugcuggugagccugggcgccaucagcuucuggaugugcagcaacggcagccugcagugcagaaucugcaucuga

SEQ ID NO: 152535 - RNA, 1701 nt, Artificial Sequence
  derived and/or modified sequence opt4 from hemagglutinin__InfluenzaA__AAF87281
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugaagggcaucgccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccagcgccugccccuacgccggcgccaacagcuucuacagaaaccugaucuggcuggugaagaagggcaacagcuaccccaagcugagcaagagcuacaucaacaacaagggcaagaaggugcuggugcuguggggcauccaccacccccccaccagcaccgaccagcagagccuguaccagaacgccgacgccuacguguucgugggcagcagcaaguacaacaagaaguucaugcccgagaucgccaccagacccaaggugagaggccaggccggcagaaugaacuacuacuggacccugaucgagcccggcgacaccaucaccuucgaggccaccggcaaccugguggugcccagauacgccuucgccauggagagaggcuacggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuaccacgacagcaacgugaagaaccuguacgagaaggugaagagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccaucgccagcagccuggugcugcuggugagccugggcgccaucagcuucuggaugugcagcaacggcagccugcagugcagaaucugcaucuga

SEQ ID NO: 152536 - RNA, 1701 nt, Artificial Sequence; identical to SEQ ID NO: 152534
  derived and/or modified sequence opt4 from hemagglutinin__InfluenzaA__AAF87282

SEQ ID NO: 152537 - RNA, 1701 nt, Artificial Sequence
  derived and/or modified sequence opt4 from hemagglutinin__InfluenzaA__AAF87283
augaaggccauccugguggugcugcuguacgccuucaccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugaagggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccagcgccugccccuacagcggcgccaacagcuucuacagaaaccugaucuggcuggugaagaagggcaacagcuaccccaagcugagcaagagcuacaucaacaacaagggcaaggaggugcuggugcuguggggcauccaccacccccccaccagcaccgaccagcagagccuguaccagaacgccgacgccuacguguucgugggcagcagcaaguacaacaagaaguucaugcccgagaucgccaccagacccaaggugagaggccaggccggcagaaugaacuacuacuggacccugaucgagcccggcgacaccaucaccuucgaggccaccggcaaccugguggcccccagauacgccuucgccauggagagaggcagcggcagcggcaucaucaucagcgacacccccguguacgacugcaacaccgccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgcccccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccugaacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccagacugaacagagaggagaucgacggcgugaagcuggagagcaccagaaucuaccagauccuggccaucuacagcaccaucgccagcagccuggugcugcuggugagccugggcgccaucagcuucuggaugugcagcaacggcagccugcagugcagaaucugcaucuga

SEQ ID NO: 152538 - RNA, 1701 nt, Artificial Sequence
  derived and/or modified sequence opt4 from hemagglutinin__InfluenzaA__AAF87284
augaaggccauccugguggugcugcuguacgccuucaccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugaagggcguggccccccugcaccugggcaagugcaacaucgccggcuggcugcugggcaaccccgagugcgagcugcuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccagcgccugccugcuguucuggagcaagcagcugcugcagaagcugaacauggccggcaagaagggcaacagcuaccccaagcugagcaagagcuacaucaacaacaagggcaaggaggugcuggugcuguggggcauccaccacccccccaccagcaccgaccagcagagccuguaccagaacgccgacgccuacguguucgugggcagcagcaaguacaacaagaaguucaugcccgagaucgccaccagacccaaggugagaggccaggccggcagaaugaacuacuacuggacccugaucgagcccggcgacaccaucaccuucgaggccaccggcaaccugguggcccccagauacgccuucgccauggagagaggcagcggcagcggcaucaucaucagcgacacccccguguacgacugcaacaccgccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccugaacguguggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccagacugaacagagaggagaucgacggcgugaagcuggagagcaccagaaucuaccagauccuggccaucuacagcaccaucgccagcagccuggugcugcuggugagccugggcgccaucagcuucuggaugugcagcaacggcagccugcagugcagaaucugcaucuga

SEQ ID NO: 152539 - RNA, 1701 nt, Artificial Sequence
  derived and/or modified sequence opt4 from hemagglutinin__InfluenzaA__AAG01749
augagcaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgagaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152540 - RNA, 1701 nt, Artificial Sequence
  derived and/or modified sequence opt4 from hemagglutinin__InfluenzaA__AAG01767
augaacaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucaucgagagaagcaaggccuacagcaacugcuaccccuacgacgugcccgacuacagcagccugagaagccugguggccagcagcggcacccuggaguucaccaacgaggacuucaacuggaccggcguggcccaggacggcggcagcuacagcugcaagagagagagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgagcagaccagccuguacgugcaggccaucggcagagugaccgugagcaccaagagcagccagcagaccgugauccccaacaucggcagcagacccugggugagaggcaucagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucgacaacugcuacagcgagugcaucacccccaacggcagcauccccaacgacaagcccuuccagaacgugaacagaaucaccuacggcgccugccccaaguacgugaagcagaagacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccaggugaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152541 - RNA, 1701 nt, Artificial Sequence
  derived and/or modified sequence opt4 from hemagglutinin__InfluenzaA__AAG01776
augaacaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucaucgagagaagcaaggccuacagcaacugcuaccccuacgacgugcccgacuacagcagccugagaagccugguggccagcagcggcacccuggaguucaccaacgaggacuucaacuggaccggcguggcccaggacggcggcagcuacagcugcaagagagagagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgagcagaccagccuguacgugcaggccaucggcagagugaccgugagcaccaagagcagccagcagaccgugauccccaacaucggcagcagacccugggugagaggcaucagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucgacaacugcuacagcgagugcaucacccccaacggcagcauccccaacgacaagcccuuccagaacgugaacagaaucaccuacggcgccugccccaaguacgugaagcagaagacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccaggugaacggcaagcugaacuggcugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152542 - RNA, 1701 nt, Artificial Sequence
  derived and/or modified sequence opt4 from hemagglutinin__InfluenzaA__AAG01785
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucaucgagagaagcaaggccuacagcaacugcuaccccuacgacgugcccgacuacagcagccugagaagccugguggccagcagcggcacccuggaguucaccaacgaggacuucaacuggaccggcguggcccaggacggcggcagcuacagcugcaagagagagagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgagcagaccagccuguacgugcaggccaucggcagagugaccgugagcaccaagagcagccagcagaccgugauccccaacaucggcagcagacccugggugagaggcaucagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucgacaacugcuacagcgagugcaucacccccaacggcagcauccccaacgacaagcccuuccagaacgugaacagaaucaccuacggcgccugccccaaguacgugaagcagaagacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccaggugaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152543 - RNA, 1701 nt, Artificial Sequence
  derived and/or modified sequence opt4 from hemagglutinin__InfluenzaA__AAK52911
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152544 - RNA, 1701 nt, Artificial Sequence
  derived and/or modified sequence opt4 from hemagglutinin__InfluenzaA__AAK52912
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaaccaaggccuacagcaacugcuaccccuacgacgugcccgacuacgccagccugagaagccugguggccagcagcggcacccuggaguucaccaacgagggcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152545 - RNA, 1701 nt, Artificial Sequence
  derived and/or modified sequence opt4 from hemagglutinin__InfluenzaA__AAK71687
augaaggccauccugguggugcugcuguacaccuucaccaccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcguggccccccugcaccugggcaagugcaacaucgccggcuggcugcugggcaaccccgagugcgagagccuguucaccgccagcagcuggagcuacaucguggagaccagcaacagcgacaacggcaccugcuaccccggcgacuucaucaacuacgaggagcugagagagcagcugagcagcgugagcagcuucgagagauucgagaucuuccccgagaccagcagcuggcccaaccacgacaccaacagaggcgugaccgccgccugcccccacgccggcgccaacagcuucuacagaaaccugaucuggcuggccaagaagggcgacagcuaccccaagcugagcaagagcuacaucaacaacaagggcaaggaggugcuggugcuguggggcauccaccacccccccaccagcgccgaccagcagagccuguaccagaacgccgacgccuacguguucgugggcagcagcagauacagcaagaaguucaagcccgagaucgccaccagacccaaggugagaggccaggccggcagaaugaacuacuacuggacccugguggagcccggcgacaagaucaccuucgaggccaccggcaaccugguggugcccagauacgccuucgccaugaagagaaacagcgagagcggcaucaucaucagcgacaucagcgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccugaagagcacccagaacgccaucgacggcaucaccaacaaggugaacagcgugaucgagaagaugaacacccaguucaccguggugggcaaggaguucaaccaccuggagaagagaaucgagaaccugaacaagaagguggacgacggcuuccuggacaucuggaccuacaacgccgagcugcuggugcugcuggagaacgagagaacccuggacuaccacgacagcaacgugaagaaccuguacgagaaggugagaagccagcugaagaacaacgccaaggagaucggcaacggcugcuucgaguucuaccacaagugcgacgacaccugcauggagagcgugaagaacggcaccuacgacuaccccaaguacagcgaggaggccaagcugaacagagaggagaucgacggcgugaagcuggagagcaccagaaucuaccagauccuggccaucuacagcaccguggccagcagccuggugcugguggugagccugggcaccaucagcuucuggaugugcagcaacggcagccugcagugcagaaucugcaucuga

SEQ ID NO: 152546 - RNA, 1707 nt, Artificial Sequence
  derived and/or modified sequence opt4 from hemagglutinin__InfluenzaA__AAS65618
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggugagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgccaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugaaggacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 152547 - RNA, 1704 nt, Artificial Sequence
  derived and/or modified sequence opt4 from hemagglutinin__InfluenzaA__AAT38819
augaacacccagauccuggccuucaucgccugcaugcugaucggcaccaagggcgacaagaucugccugggccaccacgccguggccaacggcaccaaggugaacacccugaccgagagaggcaucgagguggugaacgccaccgagaccguggagaccgugaacaucaagaagaucugcacccagggcaagagacccaccgaccugggccagugcggccugcugggcacccugaucggccccccccagugcgaccaguuccuggaguucgacgccaaccugaucaucgagagaagagagggcaccgacgugugcuaccccggcaaguucaccaacgaggagagccugagacagauccugagaggcagcggcggcaucgacaaggagagcaugggcuucaccuacagcggcaucagaaccaacggcgccaccagcgccugcagaagaagcggcagcagcuucuacgccgagaugaaguggcugcugagcaacagcgacaacgccgccuucccccagaugaccaagagcuacagaaaccccagaaacaagcccgcccugaucaucuggggcgugcaccacagcggcagcgccaccgagcagaccaagcuguacggcagcggcaacaagcugaucaccgugggcagcagcaaguaccagcagagcuucacccccagccccggcgccagaccccaggugaacggccagagcggcagaaucgacuuccacuggcugcugcuggaccccaacgacaccgugaccuucaccuucaacggcgccuucaucgcccccgacagagccagcuucuucagaggcgagagccugggcgugcagagcgacgugccccuggacagcggcugcgagggcgacugcuuccacagcggcggcaccaucgugagcagccugcccuuccagaacaucaaccccagaaccgugggcaagugccccagauacgugaagcagaccagccugcugcuggccaccggcaugagaaacgugcccgagaaccccaagcaggccuaccagaagcagaugaccagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgacaagaccaaccagcaguucgagcugaucgacaacgaguucagcgagaucgagcagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucgaccccgugaagcugagcagcggcuacaaggacaucauccugugguucagcuucggcgccagcugcuuccugcugcuggccaucgccaugggccugguguucaucugcaucaagaacggcaacaugagaugcaccaucugcaucuga

SEQ ID NO: 152548 - RNA, 1707 nt, Artificial Sequence
  derived and/or modified sequence opt4 from hemagglutinin__InfluenzaA__AAV32636
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 152549 - RNA, 1707 nt, Artificial Sequence; identical to SEQ ID NO: 152548
  derived and/or modified sequence opt4 from hemagglutinin__InfluenzaA__AAV34704

SEQ ID NO: 152550 - RNA, 1707 nt, Artificial Sequence
  derived and/or modified sequence opt4 from hemagglutinin__InfluenzaA__AAV65826
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcugggcggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 152551 - RNA, 1701 nt, Artificial Sequence
  derived and/or modified sequence opt4 from hemagglutinin__InfluenzaA__AAX11505
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152552 - RNA, 1701 nt, Artificial Sequence
  derived and/or modified sequence opt4 from hemagglutinin__InfluenzaA__AAX11525
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152553 - RNA, 1701 nt, Artificial Sequence; identical to SEQ ID NO: 152552
  derived and/or modified sequence opt4 from hemagglutinin__InfluenzaA__AAX11535

SEQ ID NO: 152554 - RNA, 1701 nt, Artificial Sequence; identical to SEQ ID NO: 152552
  derived and/or modified sequence opt4 from hemagglutinin__InfluenzaA__AAX11545

SEQ ID NO: 152555 - RNA, 1701 nt, Artificial Sequence; identical to SEQ ID NO: 152551
  derived and/or modified sequence opt4 from hemagglutinin__InfluenzaA__AAX11555

SEQ ID NO: 152556 - RNA, 1701 nt, Artificial Sequence; identical to SEQ ID NO: 152552
  derived and/or modified sequence opt4 from hemagglutinin__InfluenzaA__AAX11565

SEQ ID NO: 152557 - RNA, 1701 nt, Artificial Sequence
  derived and/or modified sequence opt4 from hemagglutinin__InfluenzaA__AAX11585
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagccagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152558 - RNA, 1701 nt, Artificial Sequence; identical to SEQ ID NO: 152552
  derived and/or modified sequence opt4 from hemagglutinin__InfluenzaA__AAX11605

SEQ ID NO: 152559 - RNA, 1701 nt, Artificial Sequence; identical to SEQ ID NO: 152552
  derived and/or modified sequence opt4 from hemagglutinin__InfluenzaA__AAX11615

SEQ ID NO: 152560 - RNA, 1701 nt, Artificial Sequence
  derived and/or modified sequence opt4 from hemagglutinin__InfluenzaA__AAX11625
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcaggccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152561 - RNA, 1701 nt, Artificial Sequence; identical to SEQ ID NO: 152552
  derived and/or modified sequence opt4 from hemagglutinin__InfluenzaA__AAX12731

SEQ ID NO: 152562 - RNA, 1701 nt, Artificial Sequence
  derived and/or modified sequence opt4 from hemagglutinin__InfluenzaA__AAX12741
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggcccugcugggcuucaucaugugggccugccagaagggcaacaucagaugcaacaucugcaucuga

SEQ ID NO: 152563 - RNA, 1701 nt, Artificial Sequence; identical to SEQ ID NO: 152552
  derived and/or modified sequence opt4 from hemagglutinin__InfluenzaA__AAX12751

SEQ ID NO: 152564 - RNA, 1701 nt, Artificial Sequence
  derived and/or modified sequence opt4 from hemagglutinin__InfluenzaA__AAX12761
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgugugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152565 - RNA, 1701 nt, Artificial Sequence
  derived and/or modified sequence opt4 from hemagglutinin__InfluenzaA__AAX12791
augaagaccaucaucgcccugagcuacauccugugccugguguucgcccagaagcugcccggcaacgacaacagcauggccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggccugugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152566 - RNA, 1701 nt, Artificial Sequence
  derived and/or modified sequence opt4 from hemagglutinin__InfluenzaA__AAX12801
augaagaccaucaucgcccugagcuacauccugugccugguguucgcccagaaguuccccggcaacgacaacagcaccgccacccugugccugggccaccacgccgugcccaacggcacccuggugaagaccaucaccaacgaccagaucgaggugaccaacgccaccgagcuggugcagagcagcagcaccgacagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152567 - RNA, 1701 nt, Artificial Sequence
  derived and/or modified sequence opt4 from hemagglutinin__InfluenzaA__AAX12811
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152568 - RNA, 1701 nt, Artificial Sequence
  derived and/or modified sequence opt4 from hemagglutinin__InfluenzaA__AAX34061
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152569 - RNA, 1701 nt, Artificial Sequence
  derived and/or modified sequence opt4 from hemagglutinin__InfluenzaA__AAX35821
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152570 - RNA, 1701 nt, Artificial Sequence; identical to SEQ ID NO: 152551
  derived and/or modified sequence opt4 from hemagglutinin__InfluenzaA__AAX35831

SEQ ID NO: 152571 - RNA, 1701 nt, Artificial Sequence
  derived and/or modified sequence opt4 from hemagglutinin__InfluenzaA__AAX35851
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152572 - RNA, 1701 nt, Artificial Sequence
  derived and/or modified sequence opt4 from hemagglutinin__InfluenzaA__AAX35861
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152573 - RNA, 1701 nt, Artificial Sequence
  derived and/or modified sequence opt4 from hemagglutinin__InfluenzaA__AAX35871
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcgccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcuucgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152574 - RNA, 1701 nt, Artificial Sequence; identical to SEQ ID NO: 152567
  derived and/or modified sequence opt4 from hemagglutinin__InfluenzaA__AAX38237

SEQ ID NO: 152575 - RNA, 1701 nt, Artificial Sequence
  derived and/or modified sequence opt4 from hemagglutinin__InfluenzaA__AAX47515
augaaggccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152576 - RNA, 1701 nt, Artificial Sequence
  derived and/or modified sequence opt4 from hemagglutinin__InfluenzaA__AAX47525
augaagaccaucaucgcccugagcuacauccugugccugguguucgcccagaagcugcccggcaacgacaacagcaccgccacccugugcaugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccgacaccgacagcaaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152577 - RNA, 1701 nt, Artificial Sequence; identical to SEQ ID NO: 152567
  derived and/or modified sequence opt4 from hemagglutinin__InfluenzaA__AAX47535

SEQ ID NO: 152578 - RNA, 1701 nt, Artificial Sequence; identical to SEQ ID NO: 152551
  derived and/or modified sequence opt4 from hemagglutinin__InfluenzaA__AAX56380

SEQ ID NO: 152579 - RNA, 1701 nt, Artificial Sequence; identical to SEQ ID NO: 152551
  derived and/or modified sequence opt4 from hemagglutinin__InfluenzaA__AAX56390

SEQ ID NO: 152580 - RNA, 1701 nt, Artificial Sequence
  derived and/or modified sequence opt4 from hemagglutinin__InfluenzaA__AAX56400
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152581 - RNA, 1701 nt, Artificial Sequence; identical to SEQ ID NO: 152551
  derived and/or modified sequence opt4 from hemagglutinin__InfluenzaA__AAX56410

SEQ ID NO: 152582 - RNA, 1701 nt, Artificial Sequence
  derived and/or modified sequence opt4 from hemagglutinin__InfluenzaA__AAX56420
augaagaccaucaucgcccugagcuacuuccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152583 - RNA, 1701 nt, Artificial Sequence
  derived and/or modified sequence opt4 from hemagglutinin__InfluenzaA__AAX56430
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152584 - RNA, 1701 nt, Artificial Sequence
  derived and/or modified sequence opt4 from hemagglutinin__InfluenzaA__AAX56440
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacaacgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152585 - RNA, 1701 nt, Artificial Sequence; identical to SEQ ID NO: 152567
  derived and/or modified sequence opt4 from hemagglutinin__InfluenzaA__AAX56450

SEQ ID NO: 152586 - RNA, 1701 nt, Artificial Sequence
  derived and/or modified sequence opt4 from hemagglutinin__InfluenzaA__AAX56460
augaagaccaucaucgcccugagcuacauccugugccugguguucgcccagaagcugcccgagaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucacccacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152587 - RNA, 1701 nt, Artificial Sequence
  derived and/or modified sequence opt4 from hemagglutinin__InfluenzaA__AAX56470
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaugagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152588 - RNA, 1701 nt, Artificial Sequence; identical to SEQ ID NO: 152571
  derived and/or modified sequence opt4 from hemagglutinin__InfluenzaA__AAX56480

SEQ ID NO: 152589 - RNA, 1701 nt, Artificial Sequence
  derived and/or modified sequence opt4 from hemagglutinin__InfluenzaA__AAX56510
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152590 - RNA, 1701 nt, Artificial Sequence; identical to SEQ ID NO: 152567
  derived and/or modified sequence opt4 from hemagglutinin__InfluenzaA__AAX56520

SEQ ID NO: 152591 - RNA, 1701 nt, Artificial Sequence
  derived and/or modified sequence opt4 from hemagglutinin__InfluenzaA__AAX56530
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152592 - RNA, 1701 nt, Artificial Sequence
  derived and/or modified sequence opt4 from hemagglutinin__InfluenzaA__AAX56550
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152593 - RNA, 1701 nt, Artificial Sequence
  derived and/or modified sequence opt4 from hemagglutinin__InfluenzaA__AAX56560
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152594 - RNA, 1701 nt, Artificial Sequence
  derived and/or modified sequence opt4 from hemagglutinin__InfluenzaA__AAX56570
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcggcaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152595 - RNA, 1701 nt, Artificial Sequence
  derived and/or modified sequence opt4 from hemagglutinin__InfluenzaA__AAX56590
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152596 - RNA, 1701 nt, Artificial Sequence; identical to SEQ ID NO: 152593
  derived and/or modified sequence opt4 from hemagglutinin__InfluenzaA__AAX56600

SEQ ID NO: 152597 - RNA, 1701 nt, Artificial Sequence
  derived and/or modified sequence opt4 from hemagglutinin__InfluenzaA__AAX57644
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccguggugaagcccggcgacauccugcugaucaacagcaccggcaaccugaucgcccccagaggcuacuucaagaugagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152598 - RNA, 1701 nt, Artificial Sequence; identical to SEQ ID NO: 152551
  derived and/or modified sequence opt4 from hemagglutinin__InfluenzaA__AAX57654

SEQ ID NO: 152599 - RNA, 1701 nt, Artificial Sequence; identical to SEQ ID NO: 152567
  derived and/or modified sequence opt4 from hemagglutinin__InfluenzaA__AAX57664

SEQ ID NO: 152600 - RNA, 1701 nt, Artificial Sequence
  derived and/or modified sequence opt4 from hemagglutinin__InfluenzaA__AAX57684
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152601 - RNA, 1701 nt, Artificial Sequence; identical to SEQ ID NO: 152571
  derived and/or modified sequence opt4 from hemagglutinin__InfluenzaA__AAX57694

SEQ ID NO: 152602 - RNA, 1701 nt, Artificial Sequence; identical to SEQ ID NO: 152593
  derived and/or modified sequence opt4 from hemagglutinin__InfluenzaA__AAX57704

SEQ ID NO: 152603 - RNA, 1701 nt, Artificial Sequence; identical to SEQ ID NO: 152571
  derived and/or modified sequence opt4 from hemagglutinin__InfluenzaA__AAX57714

SEQ ID NO: 152604 - RNA, 1701 nt, Artificial Sequence; identical to SEQ ID NO: 152600
  derived and/or modified sequence opt4 from hemagglutinin__InfluenzaA__AAX57733

SEQ ID NO: 152605 - RNA, 1701 nt, Artificial Sequence
  derived and/or modified sequence opt4 from hemagglutinin__InfluenzaA__AAX57734
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcaacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152606 - RNA, 1701 nt, Artificial Sequence; identical to SEQ ID NO: 152592
  derived and/or modified sequence opt4 from hemagglutinin__InfluenzaA__AAX57744

SEQ ID NO: 152607 - RNA, 1701 nt, Artificial Sequence; identical to SEQ ID NO: 152592
  derived and/or modified sequence opt4 from hemagglutinin__InfluenzaA__AAX57764

SEQ ID NO: 152608 - RNA, 1701 nt, Artificial Sequence; identical to SEQ ID NO: 152592
  derived and/or modified sequence opt4 from hemagglutinin__InfluenzaA__AAX57774

SEQ ID NO: 152609 - RNA, 1701 nt, Artificial Sequence
  derived and/or modified sequence opt4 from hemagglutinin__InfluenzaA__AAX57784
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152610 - RNA, 1701 nt, Artificial Sequence
  derived and/or modified sequence opt4 from hemagglutinin__InfluenzaA__AAX57794
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcauccacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152611 - RNA, 1701 nt, Artificial Sequence; identical to SEQ ID NO: 152592
  derived and/or modified sequence opt4 from hemagglutinin__InfluenzaA__AAX57814

SEQ ID NO: 152612 - RNA, 1701 nt, Artificial Sequence
  derived and/or modified sequence opt4 from hemagglutinin__InfluenzaA__AAX57824
augaagaccaucaucgcccugagcuacauccugugcaugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152613 - RNA, 1701 nt, Artificial Sequence; identical to SEQ ID NO: 152592
  derived and/or modified sequence opt4 from hemagglutinin__InfluenzaA__AAX57834

SEQ ID NO: 152614 - RNA, 1701 nt, Artificial Sequence; identical to SEQ ID NO: 152592
  derived and/or modified sequence opt4 from hemagglutinin__InfluenzaA__AAX57844

SEQ ID NO: 152615 - RNA, 1701 nt, Artificial Sequence
  derived and/or modified sequence opt4 from hemagglutinin__InfluenzaA__AAX57864
augaagaccaucaucgcccugagcuacuuccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152616 - RNA, 1701 nt, Artificial Sequence; identical to SEQ ID NO: 152592
  derived and/or modified sequence opt4 from hemagglutinin__InfluenzaA__AAX57874

SEQ ID NO: 152617 - RNA, 1701 nt, Artificial Sequence; identical to SEQ ID NO: 152592
  derived and/or modified sequence opt4 from hemagglutinin__InfluenzaA__AAX57884

SEQ ID NO: 152618 - RNA, 1701 nt, Artificial Sequence
  derived and/or modified sequence opt4 from hemagglutinin__InfluenzaA__AAX57894
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccaggugcuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152619 - RNA, 1701 nt, Artificial Sequence
  derived and/or modified sequence opt4 from hemagglutinin__InfluenzaA__AAX57924
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152620 - RNA, 1701 nt, Artificial Sequence; identical to SEQ ID NO: 152592
  derived and/or modified sequence opt4 from hemagglutinin__InfluenzaA__AAX57934

SEQ ID NO: 152621 - RNA, 1701 nt, Artificial Sequence
  derived and/or modified sequence opt4 from hemagglutinin__InfluenzaA__AAX57944
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152622 - RNA, 1701 nt, Artificial Sequence
  derived and/or modified sequence opt4 from hemagglutinin__InfluenzaA__AAX76623
augaagaccaucaucgcccugagcuacauccugugccugguguucgcccagaagcugcccggcaacgacaagagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugagaagcggcuacaaggacuggauccuguggaucagcuucgccaucagcugcuuccugcugugcguggccagccugggcuucaucaugugggccugccagaagggcaacaucagaugcaacaucugcaucuga

SEQ ID NO: 152623 - RNA, 1701 nt, Artificial Sequence
  derived and/or modified sequence opt4 from hemagglutinin__InfluenzaA__AAX76643
augaagaccaucaucgcccugagcuacuuccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152624 - RNA, 1701 nt, Artificial Sequence
  derived and/or modified sequence opt4 from hemagglutinin__InfluenzaA__AAX76653
augaagaccaucaucgcccugagcuacuuccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguucgcccaggccagcggcagaaucaccgugagcaccaagagaagccagcagaccgugauccccaacaucggcagcggccccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152625 - RNA, 1701 nt, Artificial Sequence
  derived and/or modified sequence opt4 from hemagglutinin__InfluenzaA__AAX76663
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152626 - RNA, 1701 nt, Artificial Sequence
  derived and/or modified sequence opt4 from hemagglutinin__InfluenzaA__AAX76673
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagagauacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152627 - RNA, 1701 nt, Artificial Sequence
  derived and/or modified sequence opt4 from hemagglutinin__InfluenzaA__AAX76683
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcgugaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152628 - RNA, 1701 nt, Artificial Sequence; identical to SEQ ID NO: 152592
  derived and/or modified sequence opt4 from hemagglutinin__InfluenzaA__AAX76713

SEQ ID NO: 152629 - RNA, 1701 nt, Artificial Sequence
  derived and/or modified sequence opt4 from hemagglutinin__InfluenzaA__AAX76723
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgaggaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152630 - RNA, 1701 nt, Artificial Sequence
  derived and/or modified sequence opt4 from hemagglutinin__InfluenzaA__AAX76733
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccgacagaaucugcgacagcccccaccagauccuggacggcggcaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaagaacaaguaccccgcccugaacguggccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacuacgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152631 - RNA, 1701 nt, Artificial Sequence
  derived and/or modified sequence opt4 from hemagglutinin__InfluenzaA__AAX76743
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaagaacaaguaccccgcccugaacguggccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152632 - RNA, 1701 nt, Artificial Sequence
  derived and/or modified sequence opt4 from hemagglutinin__InfluenzaA__AAX76763
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugaucgcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152633 - RNA, 1701 nt, Artificial Sequence; identical to SEQ ID NO: 152552
  derived and/or modified sequence opt4 from hemagglutinin__InfluenzaA__AAY18086

SEQ ID NO: 152634 - RNA, 1701 nt, Artificial Sequence
  derived and/or modified sequence opt4 from hemagglutinin__InfluenzaA__AAY18096
augaagaccaucaucgcccugagcugcauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152635 - RNA, 1701 nt, Artificial Sequence; identical to SEQ ID NO: 152567
  derived and/or modified sequence opt4 from hemagglutinin__InfluenzaA__AAY18106

SEQ ID NO: 152636 - RNA, 1701 nt, Artificial Sequence; identical to SEQ ID NO: 152567
  derived and/or modified sequence opt4 from hemagglutinin__InfluenzaA__AAY18116

SEQ ID NO: 152637 - RNA, 1701 nt, Artificial Sequence
  derived and/or modified sequence opt4 from hemagglutinin__InfluenzaA__AAY18126
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagggcuucaacuggaccggcgugacccagaacggcaccagcagcgccugcaagagaaagagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152638 - RNA, 1701 nt, Artificial Sequence
  derived and/or modified sequence opt4 from hemagglutinin__InfluenzaA__AAY18136
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152639 - RNA, 1701 nt, Artificial Sequence; identical to SEQ ID NO: 152592
  derived and/or modified sequence opt4 from hemagglutinin__InfluenzaA__AAY18156

SEQ ID NO: 152640 - RNA, 1701 nt, Artificial Sequence; identical to SEQ ID NO: 152592
  derived and/or modified sequence opt4 from hemagglutinin__InfluenzaA__AAY18176

SEQ ID NO: 152641 - RNA, 1701 nt, Artificial Sequence; identical to SEQ ID NO: 152592
  derived and/or modified sequence opt4 from hemagglutinin__InfluenzaA__AAY18186

SEQ ID NO: 152642 - RNA, 1701 nt, Artificial Sequence; identical to SEQ ID NO: 152593
  derived and/or modified sequence opt4 from hemagglutinin__InfluenzaA__AAY18564

SEQ ID NO: 152643 - RNA, 1701 nt, Artificial Sequence
  derived and/or modified sequence opt4 from hemagglutinin__InfluenzaA__AAY18585
augaagaccaucaucgcccugagcuacauccugugccugguguucgcccagaagcugcccgagaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152644 - RNA, 1701 nt, Artificial Sequence; identical to SEQ ID NO: 152552
  derived and/or modified sequence opt4 from hemagglutinin__InfluenzaA__AAY18611

SEQ ID NO: 152645 - RNA, 1701 nt, Artificial Sequence; identical to SEQ ID NO: 152593
  derived and/or modified sequence opt4 from hemagglutinin__InfluenzaA__AAY27843

SEQ ID NO: 152646 - RNA, 1701 nt, Artificial Sequence; identical to SEQ ID NO: 152552
  derived and/or modified sequence opt4 from hemagglutinin__InfluenzaA__AAY27853

SEQ ID NO: 152647 - RNA, 1701 nt, Artificial Sequence
  derived and/or modified sequence opt4 from hemagglutinin__InfluenzaA__AAY27863
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagaucaucgacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugaucagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152648 - RNA, 1701 nt, Artificial Sequence; identical to SEQ ID NO: 152571
  derived and/or modified sequence opt4 from hemagglutinin__InfluenzaA__AAY27959

SEQ ID NO: 152649 - RNA, 1701 nt, Artificial Sequence; identical to SEQ ID NO: 152551
  derived and/or modified sequence opt4 from hemagglutinin__InfluenzaA__AAY27994

SEQ ID NO: 152650 - RNA, 1701 nt, Artificial Sequence; identical to SEQ ID NO: 152551
  derived and/or modified sequence opt4 from hemagglutinin__InfluenzaA__AAY28004

SEQ ID NO: 152651 - RNA, 1701 nt, Artificial Sequence; identical to SEQ ID NO: 152551
  derived and/or modified sequence opt4 from hemagglutinin__InfluenzaA__AAY28265

SEQ ID NO: 152652 - RNA, 1701 nt, Artificial Sequence
  derived and/or modified sequence opt4 from hemagglutinin__InfluenzaA__AAY28275
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcgugaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152653 - RNA, 1701 nt, Artificial Sequence
  derived and/or modified sequence opt4 from hemagglutinin__InfluenzaA__AAY28285
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacaacgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152654 - RNA, 1701 nt, Artificial Sequence
  derived and/or modified sequence opt4 from hemagglutinin__InfluenzaA__AAY28295
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcaagaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagauccagagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152655 - RNA, 1701 nt, Artificial Sequence
  derived and/or modified sequence opt4 from hemagglutinin__InfluenzaA__AAY28305
augaaggccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152656 - RNA, 1701 nt, Artificial Sequence
  derived and/or modified sequence opt4 from hemagglutinin__InfluenzaA__AAY28325
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaucgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucgccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152657 - RNA, 1701 nt, Artificial Sequence
  derived and/or modified sequence opt4 from hemagglutinin__InfluenzaA__AAY28335
augaagaccaucaucgcccugagcuacauccugugccuggugagcgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152658 - RNA, 1701 nt, Artificial Sequence; identical to SEQ ID NO: 152552
  derived and/or modified sequence opt4 from hemagglutinin__InfluenzaA__AAY28345

SEQ ID NO: 152659 - RNA, 1701 nt, Artificial Sequence; identical to SEQ ID NO: 152592
  derived and/or modified sequence opt4 from hemagglutinin__InfluenzaA__AAY28355

SEQ ID NO: 152660 - RNA, 1701 nt, Artificial Sequence
  derived and/or modified sequence opt4 from hemagglutinin__InfluenzaA__AAY28363
augaagaccaucaucgcccugagcuacauccugugcaugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccagccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152661 - RNA, 1701 nt, Artificial Sequence; identical to SEQ ID NO: 152592
  derived and/or modified sequence opt4 from hemagglutinin__InfluenzaA__AAY28375

SEQ ID NO: 152662 - RNA, 1701 nt, Artificial Sequence; identical to SEQ ID NO: 152552
  derived and/or modified sequence opt4 from hemagglutinin__InfluenzaA__AAY28385

SEQ ID NO: 152663 - RNA, 1701 nt, Artificial Sequence
  derived and/or modified sequence opt4 from hemagglutinin__InfluenzaA__AAY28395
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucaaccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152664 - RNA, 1701 nt, Artificial Sequence
  derived and/or modified sequence opt4 from hemagglutinin__InfluenzaA__AAY28405
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaucagcagcaccggcagaaucugcgacaacccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcguguga

SEQ ID NO: 152665 - RNA, 1701 nt, Artificial Sequence; identical to SEQ ID NO: 152552
  derived and/or modified sequence opt4 from hemagglutinin__InfluenzaA__AAY28486

SEQ ID NO: 152666 - RNA, 1701 nt, Artificial Sequence; identical to SEQ ID NO: 152552
  derived and/or modified sequence opt4 from hemagglutinin__InfluenzaA__AAY28521

SEQ ID NO: 152667 - RNA, 1701 nt, Artificial Sequence; identical to SEQ ID NO: 152551
  derived and/or modified sequence opt4 from hemagglutinin__InfluenzaA__AAY28531

SEQ ID NO: 152668 - RNA, 1701 nt, Artificial Sequence; identical to SEQ ID NO: 152552
  derived and/or modified sequence opt4 from hemagglutinin__InfluenzaA__AAY28541

SEQ ID NO: 152669 - RNA, 1701 nt, Artificial Sequence
  derived and/or modified sequence opt4 from hemagglutinin__InfluenzaA__AAY28551
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152670 - RNA, 1701 nt, Artificial Sequence; identical to SEQ ID NO: 152552
  derived and/or modified sequence opt4 from hemagglutinin__InfluenzaA__AAY28561

SEQ ID NO: 152671 - RNA, 1701 nt, Artificial Sequence; identical to SEQ ID NO: 152567
  derived and/or modified sequence opt4 from hemagglutinin__InfluenzaA__AAY28581

SEQ ID NO: 152672 - RNA, 1701 nt, Artificial Sequence
  derived and/or modified sequence opt4 from hemagglutinin__InfluenzaA__AAY28591
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccuggacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152673 - RNA, 1701 nt, Artificial Sequence; identical to SEQ ID NO: 152592
  derived and/or modified sequence opt4 from hemagglutinin__InfluenzaA__AAY28608

SEQ ID NO: 152674 - RNA, 1701 nt, Artificial Sequence
  derived and/or modified sequence opt4 from hemagglutinin__InfluenzaA__AAY28618
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152675 - RNA, 1701 nt, Artificial Sequence; identical to SEQ ID NO: 152567
  derived and/or modified sequence opt4 from hemagglutinin__InfluenzaA__AAY28638

SEQ ID NO: 152676 - RNA, 1701 nt, Artificial Sequence
  derived and/or modified sequence opt4 from hemagglutinin__InfluenzaA__AAY28648
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152677 - RNA, 1701 nt, Artificial Sequence
  derived and/or modified sequence opt4 from hemagglutinin__InfluenzaA__AAY44610
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152678 - RNA, 1701 nt, Artificial Sequence
  derived and/or modified sequence opt4 from hemagglutinin__InfluenzaA__AAY44620
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacgagaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152679 - RNA, 1701 nt, Artificial Sequence; identical to SEQ ID NO: 152600
  derived and/or modified sequence opt4 from hemagglutinin__InfluenzaA__AAY44621

SEQ ID NO: 152680 - RNA, 1701 nt, Artificial Sequence; identical to SEQ ID NO: 152567
  derived and/or modified sequence opt4 from hemagglutinin__InfluenzaA__AAY44631

SEQ ID NO: 152681 - RNA, 1701 nt, Artificial Sequence
  derived and/or modified sequence opt4 from hemagglutinin__InfluenzaA__AAY44641
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucggccugcugggcuucaucaugugggccugccagaagggcaacaucagaugcaacaucugcaucuga

SEQ ID NO: 152682 - RNA, 1701 nt, Artificial Sequence
  derived and/or modified sequence opt4 from hemagglutinin__InfluenzaA__AAY44651
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggagagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugaaggagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152683 - RNA, 1701 nt, Artificial Sequence
  derived and/or modified sequence opt4 from hemagglutinin__InfluenzaA__AAY44755
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaggccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcgugaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152684 - RNA, 1701 nt, Artificial Sequence
  derived and/or modified sequence opt4 from hemagglutinin__InfluenzaA__AAY44775
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccaggacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaccacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152685 - RNA, 1701 nt, Artificial Sequence; identical to SEQ ID NO: 152592
  derived and/or modified sequence opt4 from hemagglutinin__InfluenzaA__AAY44785

SEQ ID NO: 152686 - RNA, 1701 nt, Artificial Sequence
  derived and/or modified sequence opt4 from hemagglutinin__InfluenzaA__AAY44795
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcacccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152687 - RNA, 1701 nt, Artificial Sequence
  derived and/or modified sequence opt4 from hemagglutinin__InfluenzaA__AAY44796
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152688 - RNA, 1701 nt, Artificial Sequence; identical to SEQ ID NO: 152567
  derived and/or modified sequence opt4 from hemagglutinin__InfluenzaA__AAY44896

SEQ ID NO: 152689 - RNA, 1701 nt, Artificial Sequence
  derived and/or modified sequence opt4 from hemagglutinin__InfluenzaA__AAY44906
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152690 - RNA, 1701 nt, Artificial Sequence
  derived and/or modified sequence opt4 from hemagglutinin__InfluenzaA__AAY46371
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccggcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152691 - RNA, 1701 nt, Artificial Sequence; identical to SEQ ID NO: 152552
  derived and/or modified sequence opt4 from hemagglutinin__InfluenzaA__AAY46381

SEQ ID NO: 152692 - RNA, 1701 nt, Artificial Sequence
  derived and/or modified sequence opt4 from hemagglutinin__InfluenzaA__AAY46391
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152693 - RNA, 1701 nt, Artificial Sequence
  derived and/or modified sequence opt4 from hemagglutinin__InfluenzaA__AAY46426
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacaagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152694 - RNA, 1701 nt, Artificial Sequence
  derived and/or modified sequence opt4 from hemagglutinin__InfluenzaA__AAY47013
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152695 - RNA, 1701 nt, Artificial Sequence
  derived and/or modified sequence opt4 from hemagglutinin__InfluenzaA__AAY47023
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggaguggggccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcaggccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152696 - RNA, 1701 nt, Artificial Sequence; identical to SEQ ID NO: 152692
  derived and/or modified sequence opt4 from hemagglutinin__InfluenzaA__AAY47052

SEQ ID NO: 152697 - RNA, 1701 nt, Artificial Sequence
  derived and/or modified sequence opt4 from hemagglutinin__InfluenzaA__AAY47075
augaagaccaucaucgcccugagcuacauccugugccugguguucgcccagaagcugcccggcaacgacaacagcauggccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaagaacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152698 - RNA, 1701 nt, Artificial Sequence
  derived and/or modified sequence opt4 from hemagglutinin__InfluenzaA__AAY47085
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacgugggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152699 - RNA, 1701 nt, Artificial Sequence
  derived and/or modified sequence opt4 from hemagglutinin__InfluenzaA__AAY58320
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152700 - RNA, 1701 nt, Artificial Sequence
  derived and/or modified sequence opt4 from hemagglutinin__InfluenzaA__AAY59035
augaagaccaucaucgcccugagcuacauccugugccugguguucgcccagaagcugaccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152701 - RNA, 1701 nt, Artificial Sequence
  derived and/or modified sequence opt4 from hemagglutinin__InfluenzaA__AAY64202
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcgagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaacagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152702 - RNA, 1701 nt, Artificial Sequence
  derived and/or modified sequence opt4 from hemagglutinin__InfluenzaA__AAY64212
augaagaccaucaucgcccugagcuacauccugugccugguguucgcccagaagauccccgugaacgacaacagcaccgccacccugugccugggccaccacgccgugcccaacggcacccuggugaagaccaucaccaacgagcacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccugaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152703 - RNA, 1701 nt, Artificial Sequence
  derived and/or modified sequence opt4 from hemagglutinin__InfluenzaA__AAY64222
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaucggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcagcugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152704 - RNA, 1701 nt, Artificial Sequence
  derived and/or modified sequence opt4 from hemagglutinin__InfluenzaA__AAY64262
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152705 - RNA, 1701 nt, Artificial Sequence
  derived and/or modified sequence opt4 from hemagglutinin__InfluenzaA__AAY64272
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152706 - RNA, 1701 nt, Artificial Sequence
  derived and/or modified sequence opt4 from hemagglutinin__InfluenzaA__AAY64282
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152707 - RNA, 1701 nt, Artificial Sequence
  derived and/or modified sequence opt4 from hemagglutinin__InfluenzaA__AAY64292
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccgacaagaucugcgacagcccccaccagauccuggacggcggcaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaagaacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152708 - RNA, 1701 nt, Artificial Sequence
  derived and/or modified sequence opt4 from hemagglutinin__InfluenzaA__AAY64302
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgugugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152709 - RNA, 1701 nt, Artificial Sequence; identical to SEQ ID NO: 152703
  derived and/or modified sequence opt4 from hemagglutinin__InfluenzaA__AAY64312

SEQ ID NO: 152710 - RNA, 1701 nt, Artificial Sequence; identical to SEQ ID NO: 152706
  derived and/or modified sequence opt4 from hemagglutinin__InfluenzaA__AAY64322

SEQ ID NO: 152711 - RNA, 1701 nt, Artificial Sequence
  derived and/or modified sequence opt4 from hemagglutinin__InfluenzaA__AAY64332
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 152712 - RNA, 1701 nt, Artificial Sequence
  derived and/or modified sequence opt4 from hemagglutinin__InfluenzaA__AAY64342
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152713 - RNA, 1701 nt, Artificial Sequence; identical to SEQ ID NO: 152552
  derived and/or modified sequence opt4 from hemagglutinin__InfluenzaA__AAY64352

SEQ ID NO: 152714 - RNA, 1701 nt, Artificial Sequence
  derived and/or modified sequence opt4 from hemagglutinin__InfluenzaA__AAY64362
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152715 - RNA, 1701 nt, Artificial Sequence; identical to SEQ ID NO: 152706
  derived and/or modified sequence opt4 from hemagglutinin__InfluenzaA__AAY64382

SEQ ID NO: 152716 - RNA, 1701 nt, Artificial Sequence
  derived and/or modified sequence opt4 from hemagglutinin__InfluenzaA__AAY64392
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152717 - RNA, 1701 nt, Artificial Sequence; identical to SEQ ID NO: 152708
  derived and/or modified sequence opt4 from hemagglutinin__InfluenzaA__AAY64402

SEQ ID NO: 152718 - RNA, 1701 nt, Artificial Sequence; identical to SEQ ID NO: 152706
  derived and/or modified sequence opt4 from hemagglutinin__InfluenzaA__AAY98037

SEQ ID NO: 152719 - RNA, 1701 nt, Artificial Sequence; identical to SEQ ID NO: 152706
  derived and/or modified sequence opt4 from hemagglutinin__InfluenzaA__AAY98047

SEQ ID NO: 152720 - RNA, 1701 nt, Artificial Sequence; identical to SEQ ID NO: 152567
  derived and/or modified sequence opt4 from hemagglutinin__InfluenzaA__AAY98057

SEQ ID NO: 152721 - RNA, 1701 nt, Artificial Sequence
  derived and/or modified sequence opt4 from hemagglutinin__InfluenzaA__AAY98067
augaagaccaucaucgcccugagcuacauccugugccugguguucgcccaggagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152722 - RNA, 1701 nt, Artificial Sequence
  derived and/or modified sequence opt4 from hemagglutinin__InfluenzaA__AAY98077
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcgccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152723 - RNA, 1701 nt, Artificial Sequence
  derived and/or modified sequence opt4 from hemagglutinin__InfluenzaA__AAY98087
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152724 - RNA, 1701 nt, Artificial Sequence; identical to SEQ ID NO: 152706
  derived and/or modified sequence opt4 from hemagglutinin__InfluenzaA__AAY98097

SEQ ID NO: 152725 - RNA, 1701 nt, Artificial Sequence; identical to SEQ ID NO: 152706
  derived and/or modified sequence opt4 from hemagglutinin__InfluenzaA__AAY98107

SEQ ID NO: 152726 - RNA, 1701 nt, Artificial Sequence
  derived and/or modified sequence opt4 from hemagglutinin__InfluenzaA__AAY98117
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaggcagcaacaagagcuucuucagcagacugaacuggcugcaccagcugaaguacaaguaccccgcccugaacgugaccaugcccaacaacgagaaguucgagaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152727 - RNA, 1701 nt, Artificial Sequence; identical to SEQ ID NO: 152706
  derived and/or modified sequence opt4 from hemagglutinin__InfluenzaA__AAY98147

SEQ ID NO: 152728 - RNA, 1701 nt, Artificial Sequence; identical to SEQ ID NO: 152706
  derived and/or modified sequence opt4 from hemagglutinin__InfluenzaA__AAY98157

SEQ ID NO: 152729 - RNA, 1701 nt, Artificial Sequence
  derived and/or modified sequence opt4 from hemagglutinin__InfluenzaA__AAY98167
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcacccagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152730 - RNA, 1701 nt, Artificial Sequence
  derived and/or modified sequence opt4 from hemagglutinin__InfluenzaA__AAY98177
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152731 - RNA, 1701 nt, Artificial Sequence
  derived and/or modified sequence opt4 from hemagglutinin__InfluenzaA__AAY98195
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152732 - RNA, 1701 nt, Artificial Sequence; identical to SEQ ID NO: 152706
  derived and/or modified sequence opt4 from hemagglutinin__InfluenzaA__AAY98207

SEQ ID NO: 152733 - RNA, 1701 nt, Artificial Sequence; identical to SEQ ID NO: 152708
  derived and/or modified sequence opt4 from hemagglutinin__InfluenzaA__AAY98217

SEQ ID NO: 152734 - RNA, 1701 nt, Artificial Sequence; identical to SEQ ID NO: 152706
  derived and/or modified sequence opt4 from hemagglutinin__InfluenzaA__AAY98227

SEQ ID NO: 152735 - RNA, 1701 nt, Artificial Sequence; identical to SEQ ID NO: 152706
  derived and/or modified sequence opt4 from hemagglutinin__InfluenzaA__AAY98237

SEQ ID NO: 152736 - RNA, 1701 nt, Artificial Sequence
  derived and/or modified sequence opt4 from hemagglutinin__InfluenzaA__AAY98247
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152737 - RNA, 1701 nt, Artificial Sequence; identical to SEQ ID NO: 152706
  derived and/or modified sequence opt4 from hemagglutinin__InfluenzaA__AAY98319

SEQ ID NO: 152738 - RNA, 1701 nt, Artificial Sequence
  derived and/or modified sequence opt4 from hemagglutinin__InfluenzaA__AAY98329
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccugggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152739 - RNA, 1701 nt, Artificial Sequence; identical to SEQ ID NO: 152706
  derived and/or modified sequence opt4 from hemagglutinin__InfluenzaA__AAY98339

SEQ ID NO: 152740 - RNA, 1701 nt, Artificial Sequence; identical to SEQ ID NO: 152706
  derived and/or modified sequence opt4 from hemagglutinin__InfluenzaA__AAY98353

SEQ ID NO: 152741 - RNA, 1701 nt, Artificial Sequence
  derived and/or modified sequence opt4 from hemagglutinin__InfluenzaA__AAY98366
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccggcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152742 - RNA, 1701 nt, Artificial Sequence
  derived and/or modified sequence opt4 from hemagglutinin__InfluenzaA__AAY98376
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152743 - RNA, 1701 nt, Artificial Sequence
  derived and/or modified sequence opt4 from hemagglutinin__InfluenzaA__AAY98386
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcggcaacugcacccugaucgacgcccugcugggcgacccccacugcgacggcuuccagaacaaggagugggaccuguucguggagagaagcaagguguacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152744 - RNA, 1701 nt, Artificial Sequence; identical to SEQ ID NO: 152706
  derived and/or modified sequence opt4 from hemagglutinin__InfluenzaA__AAY98396

SEQ ID NO: 152745 - RNA, 1701 nt, Artificial Sequence; identical to SEQ ID NO: 152706
  derived and/or modified sequence opt4 from hemagglutinin__InfluenzaA__AAY98406

SEQ ID NO: 152746 - RNA, 1701 nt, Artificial Sequence
  derived and/or modified sequence opt4 from hemagglutinin__InfluenzaA__AAZ32946
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcgaggccuacagcaacugcuaccccuacgacgugcccgacuacgccagccugagaagccugaucgccagcagcggcacccuggaguucaccaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacaucaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152747 - RNA, 1701 nt, Artificial Sequence
  derived and/or modified sequence opt4 from hemagglutinin__InfluenzaA__AAZ32949
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcgaggccuacagcaacugcuaccccuacgacgugcccgacuacgccagccugagaagccugaucgccagcagcggcacccuggaguucaccaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacaucaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152748 - RNA, 1701 nt, Artificial Sequence
  derived and/or modified sequence opt4 from hemagglutinin__InfluenzaA__AAZ32950
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcgaggccuacagcaacugcuaccccuacgacgugcccgacuacgccagccugagaagccugaucgccagcagcggcacccuggaguucaccaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacaucaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaaggagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152749 - RNA, 1701 nt, Artificial Sequence
  derived and/or modified sequence opt4 from hemagglutinin__InfluenzaA__AAZ32951
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugcaccagcugaaguacaaguaccccgcccugaacguggccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152750 - RNA, 1701 nt, Artificial Sequence
  derived and/or modified sequence opt4 from hemagglutinin__InfluenzaA__AAZ32952
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugcaccagcugaaguacaaguaccccgcccugaacguggccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152751 - RNA, 1701 nt, Artificial Sequence
  derived and/or modified sequence opt4 from hemagglutinin__InfluenzaA__AAZ32953
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugcaccagcugaaguacaaguaccccgcccugaacguggccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152752 - RNA, 1701 nt, Artificial Sequence
  derived and/or modified sequence opt4 from hemagglutinin__InfluenzaA__AAZ38462
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcacuaccccggcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152753 - RNA, 1701 nt, Artificial Sequence
  derived and/or modified sequence opt4 from hemagglutinin__InfluenzaA__AAZ38473
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucaccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgugugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152754 - RNA, 1701 nt, Artificial Sequence; identical to SEQ ID NO: 152706
  derived and/or modified sequence opt4 from hemagglutinin__InfluenzaA__AAZ38484

SEQ ID NO: 152755 - RNA, 1701 nt, Artificial Sequence
  derived and/or modified sequence opt4 from hemagglutinin__InfluenzaA__AAZ38495
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152756 - RNA, 1701 nt, Artificial Sequence
  derived and/or modified sequence opt4 from hemagglutinin__InfluenzaA__AAZ38517
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcaacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152757 - RNA, 1701 nt, Artificial Sequence
  derived and/or modified sequence opt4 from hemagglutinin__InfluenzaA__AAZ38539
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacaucuuccugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152758 - RNA, 1701 nt, Artificial Sequence; identical to SEQ ID NO: 152706
  derived and/or modified sequence opt4 from hemagglutinin__InfluenzaA__AAZ38561

SEQ ID NO: 152759 - RNA, 1701 nt, Artificial Sequence
  derived and/or modified sequence opt4 from hemagglutinin__InfluenzaA__AAZ38583
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggaucaucuggaucagcuucgccaucagcugcuuccugcugugcguggcccugcugggcuucaucaugugggccugccagaagggcaacaucagaugcaacaucugcaucuga

SEQ ID NO: 152760 - RNA, 1701 nt, Artificial Sequence
  derived and/or modified sequence opt4 from hemagglutinin__InfluenzaA__AAZ38594
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152761 - RNA, 1701 nt, Artificial Sequence
  derived and/or modified sequence opt4 from hemagglutinin__InfluenzaA__AAZ38605
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccagcaucggcagcagacccagaaucagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152762 - RNA, 1698 nt, Artificial Sequence
  derived and/or modified sequence opt4 from hemagglutinin__InfluenzaA__AAZ38627
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152763 - RNA, 1701 nt, Artificial Sequence
  derived and/or modified sequence opt4 from hemagglutinin__InfluenzaA__AAZ38638
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152764 - RNA, 1701 nt, Artificial Sequence; identical to SEQ ID NO: 152763
  derived and/or modified sequence opt4 from hemagglutinin__InfluenzaA__AAZ38650

SEQ ID NO: 152765 - RNA, 1701 nt, Artificial Sequence
  derived and/or modified sequence opt4 from hemagglutinin__InfluenzaA__AAZ43370
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucaucgagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaagagcuucuucagcagacugaacuggcuguacgagagcgaguacaaguaccccgcccugaacgugaccaugcccaacaacggcaaguucgacaagcuguacaucuggggcgugcaccaccccagcaccgagaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152766 - RNA, 1701 nt, Artificial Sequence; identical to SEQ ID NO: 152638
  derived and/or modified sequence opt4 from hemagglutinin__InfluenzaA__AAZ43394

SEQ ID NO: 152767 - RNA, 1701 nt, Artificial Sequence
  derived and/or modified sequence opt4 from hemagglutinin__InfluenzaA__AAZ43405
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152768 - RNA, 1701 nt, Artificial Sequence; identical to SEQ ID NO: 152567
  derived and/or modified sequence opt4 from hemagglutinin__InfluenzaA__AAZ74352

SEQ ID NO: 152769 - RNA, 1701 nt, Artificial Sequence; identical to SEQ ID NO: 152723
  derived and/or modified sequence opt4 from hemagglutinin__InfluenzaA__AAZ74363

SEQ ID NO: 152770 - RNA, 1698 nt, Artificial Sequence
  derived and/or modified sequence opt4 from hemagglutinin__InfluenzaA__AAZ74374
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacggcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacguguggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152771 - RNA, 1701 nt, Artificial Sequence
  derived and/or modified sequence opt4 from hemagglutinin__InfluenzaA__AAZ74397
augaacaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccugugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccggcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152772 - RNA, 1701 nt, Artificial Sequence
  derived and/or modified sequence opt4 from hemagglutinin__InfluenzaA__AAZ74408
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152773 - RNA, 1701 nt, Artificial Sequence; identical to SEQ ID NO: 152706
  derived and/or modified sequence opt4 from hemagglutinin__InfluenzaA__AAZ74430

SEQ ID NO: 152774 - RNA, 1701 nt, Artificial Sequence; identical to SEQ ID NO: 152763
  derived and/or modified sequence opt4 from hemagglutinin__InfluenzaA__AAZ74441

SEQ ID NO: 152775 - RNA, 1701 nt, Artificial Sequence
  derived and/or modified sequence opt4 from hemagglutinin__InfluenzaA__AAZ74452
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152776 - RNA, 1701 nt, Artificial Sequence
  derived and/or modified sequence opt4 from hemagglutinin__InfluenzaA__AAZ74463
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152777 - RNA, 1701 nt, Artificial Sequence
  derived and/or modified sequence opt4 from hemagglutinin__InfluenzaA__AAZ74474
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagaagagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152778 - RNA, 1701 nt, Artificial Sequence; identical to SEQ ID NO: 152775
  derived and/or modified sequence opt4 from hemagglutinin__InfluenzaA__AAZ74485

SEQ ID NO: 152779 - RNA, 1701 nt, Artificial Sequence; identical to SEQ ID NO: 152776
  derived and/or modified sequence opt4 from hemagglutinin__InfluenzaA__AAZ74496

SEQ ID NO: 152780 - RNA, 1701 nt, Artificial Sequence; identical to SEQ ID NO: 152775
  derived and/or modified sequence opt4 from hemagglutinin__InfluenzaA__AAZ74507

SEQ ID NO: 152781 - RNA, 1701 nt, Artificial Sequence; identical to SEQ ID NO: 152776
  derived and/or modified sequence opt4 from hemagglutinin__InfluenzaA__AAZ74518

SEQ ID NO: 152782 - RNA, 1701 nt, Artificial Sequence; identical to SEQ ID NO: 152775
  derived and/or modified sequence opt4 from hemagglutinin__InfluenzaA__AAZ74529

SEQ ID NO: 152783 - RNA, 1701 nt, Artificial Sequence
  derived and/or modified sequence opt4 from hemagglutinin__InfluenzaA__AAZ74551
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacacccuggaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152784 - RNA, 1701 nt, Artificial Sequence; identical to SEQ ID NO: 152706
  derived and/or modified sequence opt4 from hemagglutinin__InfluenzaA__AAZ74562

SEQ ID NO: 152785 - RNA, 1701 nt, Artificial Sequence
  derived and/or modified sequence opt4 from hemagglutinin__InfluenzaA__AAZ74573
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccggcaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152786 - RNA, 1701 nt, Artificial Sequence
  derived and/or modified sequence opt4 from hemagglutinin__InfluenzaA__AAZ74584
augaagaccaucaucgcccugagcuacauccugugccugguguucgcccagaagcugcccggcaacgacaacagcaccgccacccugugccugggccaccacgccgugcccaacggcacccuggugaagaccaucgccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccagaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152787 - RNA, 1701 nt, Artificial Sequence; identical to SEQ ID NO: 152763
  derived and/or modified sequence opt4 from hemagglutinin__InfluenzaA__AAZ74595

SEQ ID NO: 152788 - RNA, 1701 nt, Artificial Sequence
  derived and/or modified sequence opt4 from hemagglutinin__InfluenzaA__AAZ74617
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152789 - RNA, 1701 nt, Artificial Sequence; identical to SEQ ID NO: 152567
  derived and/or modified sequence opt4 from hemagglutinin__InfluenzaA__AAZ79505

SEQ ID NO: 152790 - RNA, 1701 nt, Artificial Sequence
  derived and/or modified sequence opt4 from hemagglutinin__InfluenzaA__AAZ79516
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugccugaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152791 - RNA, 1701 nt, Artificial Sequence
  derived and/or modified sequence opt4 from hemagglutinin__InfluenzaA__AAZ79527
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagagacagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagagauacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152792 - RNA, 1698 nt, Artificial Sequence
  derived and/or modified sequence opt4 from hemagglutinin__InfluenzaA__AAZ79549
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcaaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152793 - RNA, 1701 nt, Artificial Sequence
  derived and/or modified sequence opt4 from hemagglutinin__InfluenzaA__AAZ79560
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugaagagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152794 - RNA, 1701 nt, Artificial Sequence
  derived and/or modified sequence opt4 from hemagglutinin__InfluenzaA__AAZ79571
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgaccccagaugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152795 - RNA, 1701 nt, Artificial Sequence
  derived and/or modified sequence opt4 from hemagglutinin__InfluenzaA__AAZ79582
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152796 - RNA, 1698 nt, Artificial Sequence
  derived and/or modified sequence opt4 from hemagglutinin__InfluenzaA__AAZ79604
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacagaaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152797 - RNA, 1701 nt, Artificial Sequence
  derived and/or modified sequence opt4 from hemagglutinin__InfluenzaA__AAZ79615
augaagaccaucaucgcccugagcuacauccugugccugguguucgcccagaagauccccggcaacgacaacagcaccgccacccugugcgugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152798 - RNA, 1701 nt, Artificial Sequence
  derived and/or modified sequence opt4 from hemagglutinin__InfluenzaA__AAZ79627
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaaggugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152799 - RNA, 1701 nt, Artificial Sequence; identical to SEQ ID NO: 152776
  derived and/or modified sequence opt4 from hemagglutinin__InfluenzaA__AAZ79941

SEQ ID NO: 152800 - RNA, 1701 nt, Artificial Sequence; identical to SEQ ID NO: 152775
  derived and/or modified sequence opt4 from hemagglutinin__InfluenzaA__AAZ79944

SEQ ID NO: 152801 - RNA, 1701 nt, Artificial Sequence
  derived and/or modified sequence opt4 from hemagglutinin__InfluenzaA__AAZ79963
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccagcaucggcagcagacccagaaucagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152802 - RNA, 1701 nt, Artificial Sequence
  derived and/or modified sequence opt4 from hemagglutinin__InfluenzaA__AAZ79974
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152803 - RNA, 1701 nt, Artificial Sequence; identical to SEQ ID NO: 152775
  derived and/or modified sequence opt4 from hemagglutinin__InfluenzaA__AAZ79996

SEQ ID NO: 152804 - RNA, 1701 nt, Artificial Sequence
  derived and/or modified sequence opt4 from hemagglutinin__InfluenzaA__AAZ80007
augaagaccaucaucgcccugagccacaucuucugccuggugcugggccaguaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcgagagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 152805 - RNA, 1701 nt, Artificial Sequence; identical to SEQ ID NO: 152776
  derived and/or modified sequence opt4 from hemagglutinin__InfluenzaA__AAZ80017

SEQ ID NO: 152806 - RNA, 1701 nt, Artificial Sequence
  derived and/or modified sequence opt4 from hemagglutinin__InfluenzaA__AAZ80030
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152807 - RNA, 1701 nt, Artificial Sequence
  derived and/or modified sequence opt4 from hemagglutinin__InfluenzaA__AAZ83242
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucaaccuguacgcccaggccagcggcagaaucaccgugagcaccaagagaagccagcagaccgugauccccaacaucggcuacagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152808 - RNA, 1701 nt, Artificial Sequence
  derived and/or modified sequence opt4 from hemagglutinin__InfluenzaA__AAZ83266
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaacgagcuggugcagagcagcagcaccggcagaaucugcgacagcccccaccagauccuggacggcgagaacugcacccugaucgacgcccugcugggcgaccccagaugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152809 - RNA, 1701 nt, Artificial Sequence; identical to SEQ ID NO: 152706
  derived and/or modified sequence opt4 from hemagglutinin__InfluenzaA__AAZ83277

SEQ ID NO: 152810 - RNA, 1701 nt, Artificial Sequence; identical to SEQ ID NO: 152592
  derived and/or modified sequence opt4 from hemagglutinin__InfluenzaA__AAZ83288

SEQ ID NO: 152811 - RNA, 1701 nt, Artificial Sequence
  derived and/or modified sequence opt4 from hemagglutinin__InfluenzaA__AAZ83312
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaucagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152812 - RNA, 1701 nt, Artificial Sequence
  derived and/or modified sequence opt4 from hemagglutinin__InfluenzaA__AAZ83323
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcaggacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugaucagcaacaucggcagcagacccugggugagaggcgugagcagcagaaucagcaucuacuggaccaucgugaagcccggcgacauccugcugaucaccagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152813 - RNA, 1701 nt, Artificial Sequence; identical to SEQ ID NO: 152802
  derived and/or modified sequence opt4 from hemagglutinin__InfluenzaA__AAZ83371

SEQ ID NO: 152814 - RNA, 1701 nt, Artificial Sequence; identical to SEQ ID NO: 152775
  derived and/or modified sequence opt4 from hemagglutinin__InfluenzaA__AAZ83688

SEQ ID NO: 152815 - RNA, 1698 nt, Artificial Sequence
  derived and/or modified sequence opt4 from hemagglutinin__InfluenzaA__ABA06510
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucgccaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152816 - RNA, 1698 nt, Artificial Sequence
  derived and/or modified sequence opt4 from hemagglutinin__InfluenzaA__ABA08464
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152817 - RNA, 1698 nt, Artificial Sequence; identical to SEQ ID NO: 152816
  derived and/or modified sequence opt4 from hemagglutinin__InfluenzaA__ABA08486

SEQ ID NO: 152818 - RNA, 1698 nt, Artificial Sequence
  derived and/or modified sequence opt4 from hemagglutinin__InfluenzaA__ABA08508
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaagaagaaggaggugcugauccuguggggcgugcaccacccccccaacaucggcgugcagagaacccuguacuacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152819 - RNA, 1698 nt, Artificial Sequence
  derived and/or modified sequence opt4 from hemagglutinin__InfluenzaA__ABA12707
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152820 - RNA, 1698 nt, Artificial Sequence
  derived and/or modified sequence opt4 from hemagglutinin__InfluenzaA__ABA12715
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccugguguuccuggugagccugggcgccaucagcuucuggaugugcagcaacggcagccugcagugcagaaucugcaucuga

SEQ ID NO: 152821 - RNA, 1698 nt, Artificial Sequence
  derived and/or modified sequence opt4 from hemagglutinin__InfluenzaA__ABA12729
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacaucagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccagauacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152822 - RNA, 1701 nt, Artificial Sequence; identical to SEQ ID NO: 152806
  derived and/or modified sequence opt4 from hemagglutinin__InfluenzaA__ABA12740

SEQ ID NO: 152823 - RNA, 1701 nt, Artificial Sequence; identical to SEQ ID NO: 152775
  derived and/or modified sequence opt4 from hemagglutinin__InfluenzaA__ABA12751

SEQ ID NO: 152824 - RNA, 1701 nt, Artificial Sequence
  derived and/or modified sequence opt4 from hemagglutinin__InfluenzaA__ABA12762
augaagaccaucaucgcccugagcuacauccugugccugguguucgcccagaaguuccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152825 - RNA, 1701 nt, Artificial Sequence
  derived and/or modified sequence opt4 from hemagglutinin__InfluenzaA__ABA12773
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152826 - RNA, 1701 nt, Artificial Sequence
  derived and/or modified sequence opt4 from hemagglutinin__InfluenzaA__ABA12780
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucgagagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152827 - RNA, 1701 nt, Artificial Sequence
  derived and/or modified sequence opt4 from hemagglutinin__InfluenzaA__ABA16214
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaagagcuucuucagcagacugaacuggcuguacgagagcgagagcaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcggcugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgacaugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152828 - RNA, 1701 nt, Artificial Sequence; identical to SEQ ID NO: 152776
  derived and/or modified sequence opt4 from hemagglutinin__InfluenzaA__ABA18026

SEQ ID NO: 152829 - RNA, 1698 nt, Artificial Sequence
  derived and/or modified sequence opt4 from hemagglutinin__InfluenzaA__ABA18037
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugaaggagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152830 - RNA, 1701 nt, Artificial Sequence; identical to SEQ ID NO: 152775
  derived and/or modified sequence opt4 from hemagglutinin__InfluenzaA__ABA18048

SEQ ID NO: 152831 - RNA, 1701 nt, Artificial Sequence
  derived and/or modified sequence opt4 from hemagglutinin__InfluenzaA__ABA18123
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152832 - RNA, 1701 nt, Artificial Sequence; identical to SEQ ID NO: 152775
  derived and/or modified sequence opt4 from hemagglutinin__InfluenzaA__ABA18134

SEQ ID NO: 152833 - RNA, 1698 nt, Artificial Sequence; identical to SEQ ID NO: 152819
  derived and/or modified sequence opt4 from hemagglutinin__InfluenzaA__ABA18145

SEQ ID NO: 152834 - RNA, 1701 nt, Artificial Sequence; identical to SEQ ID NO: 152776
  derived and/or modified sequence opt4 from hemagglutinin__InfluenzaA__ABA18156

SEQ ID NO: 152835 - RNA, 1701 nt, Artificial Sequence
  derived and/or modified sequence opt4 from hemagglutinin__InfluenzaA__ABA26700
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152836 - RNA, 1701 nt, Artificial Sequence
  derived and/or modified sequence opt4 from hemagglutinin__InfluenzaA__ABA26711
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152837 - RNA, 1701 nt, Artificial Sequence
  derived and/or modified sequence opt4 from hemagglutinin__InfluenzaA__ABA26722
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagccccaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcggcugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152838 - RNA, 1701 nt, Artificial Sequence; identical to SEQ ID NO: 152763
  derived and/or modified sequence opt4 from hemagglutinin__InfluenzaA__ABA26733

SEQ ID NO: 152839 - RNA, 1701 nt, Artificial Sequence; identical to SEQ ID NO: 152763
  derived and/or modified sequence opt4 from hemagglutinin__InfluenzaA__ABA26755

SEQ ID NO: 152840 - RNA, 1701 nt, Artificial Sequence; identical to SEQ ID NO: 152802
  derived and/or modified sequence opt4 from hemagglutinin__InfluenzaA__ABA26766

SEQ ID NO: 152841 - RNA, 1701 nt, Artificial Sequence; identical to SEQ ID NO: 152802
  derived and/or modified sequence opt4 from hemagglutinin__InfluenzaA__ABA26788

SEQ ID NO: 152842 - RNA, 1701 nt, Artificial Sequence; identical to SEQ ID NO: 152802
  derived and/or modified sequence opt4 from hemagglutinin__InfluenzaA__ABA26799

SEQ ID NO: 152843 - RNA, 1698 nt, Artificial Sequence
  derived and/or modified sequence opt4 from hemagglutinin__InfluenzaA__ABA42247
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152844 - RNA, 1698 nt, Artificial Sequence; identical to SEQ ID NO: 152816
  derived and/or modified sequence opt4 from hemagglutinin__InfluenzaA__ABA42258

SEQ ID NO: 152845 - RNA, 1701 nt, Artificial Sequence; identical to SEQ ID NO: 152775
  derived and/or modified sequence opt4 from hemagglutinin__InfluenzaA__ABA42269

SEQ ID NO: 152846 - RNA, 1698 nt, Artificial Sequence
  derived and/or modified sequence opt4 from hemagglutinin__InfluenzaA__ABA42280
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152847 - RNA, 1701 nt, Artificial Sequence
  derived and/or modified sequence opt4 from hemagglutinin__InfluenzaA__ABA42291
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaccgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152848 - RNA, 1701 nt, Artificial Sequence; identical to SEQ ID NO: 152571
  derived and/or modified sequence opt4 from hemagglutinin__InfluenzaA__ABA42302

SEQ ID NO: 152849 - RNA, 1701 nt, Artificial Sequence; identical to SEQ ID NO: 152625
  derived and/or modified sequence opt4 from hemagglutinin__InfluenzaA__ABA42313

SEQ ID NO: 152850 - RNA, 1701 nt, Artificial Sequence; identical to SEQ ID NO: 152571
  derived and/or modified sequence opt4 from hemagglutinin__InfluenzaA__ABA42346

SEQ ID NO: 152851 - RNA, 1701 nt, Artificial Sequence; identical to SEQ ID NO: 152625
  derived and/or modified sequence opt4 from hemagglutinin__InfluenzaA__ABA42357

SEQ ID NO: 152852 - RNA, 1701 nt, Artificial Sequence
  derived and/or modified sequence opt4 from hemagglutinin__InfluenzaA__ABA42379
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuucgugcugugcaucgugcugcugggcuucaucaugugggccugccagaagggcaacaucagaugcaacaucugcaucuga

SEQ ID NO: 152853 - RNA, 1701 nt, Artificial Sequence; identical to SEQ ID NO: 152600
  derived and/or modified sequence opt4 from hemagglutinin__InfluenzaA__ABA42390

SEQ ID NO: 152854 - RNA, 1701 nt, Artificial Sequence
  derived and/or modified sequence opt4 from hemagglutinin__InfluenzaA__ABA42401
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccagagcagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcaagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152855 - RNA, 1701 nt, Artificial Sequence
  derived and/or modified sequence opt4 from hemagglutinin__InfluenzaA__ABA42412
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccagcggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152856 - RNA, 1701 nt, Artificial Sequence; identical to SEQ ID NO: 152567
  derived and/or modified sequence opt4 from hemagglutinin__InfluenzaA__ABA42443

SEQ ID NO: 152857 - RNA, 1701 nt, Artificial Sequence; identical to SEQ ID NO: 152571
  derived and/or modified sequence opt4 from hemagglutinin__InfluenzaA__ABA42454

SEQ ID NO: 152858 - RNA, 1701 nt, Artificial Sequence
  derived and/or modified sequence opt4 from hemagglutinin__InfluenzaA__ABA42465
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccuggggcagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152859 - RNA, 1701 nt, Artificial Sequence
  derived and/or modified sequence opt4 from hemagglutinin__InfluenzaA__ABA42476
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagaaacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152860 - RNA, 1701 nt, Artificial Sequence
  derived and/or modified sequence opt4 from hemagglutinin__InfluenzaA__ABA42498
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152861 - RNA, 1701 nt, Artificial Sequence; identical to SEQ ID NO: 152592
  derived and/or modified sequence opt4 from hemagglutinin__InfluenzaA__ABA42509

SEQ ID NO: 152862 - RNA, 1701 nt, Artificial Sequence
  derived and/or modified sequence opt4 from hemagglutinin__InfluenzaA__ABA42520
augaagaccaucaucgcccugagcuacauccugugccugguguucgcccagaagcugcccgugaacgacaacagcaccgccacccugugccugggccaccacgccgugcccaacggcacccuggugaagaccaucaccaacgacuacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152863 - RNA, 1701 nt, Artificial Sequence
  derived and/or modified sequence opt4 from hemagglutinin__InfluenzaA__ABA42531
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccuguacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152864 - RNA, 1701 nt, Artificial Sequence; identical to SEQ ID NO: 152592
  derived and/or modified sequence opt4 from hemagglutinin__InfluenzaA__ABA42542

SEQ ID NO: 152865 - RNA, 1701 nt, Artificial Sequence
  derived and/or modified sequence opt4 from hemagglutinin__InfluenzaA__ABA42553
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgcccacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152866 - RNA, 1701 nt, Artificial Sequence; identical to SEQ ID NO: 152592
  derived and/or modified sequence opt4 from hemagglutinin__InfluenzaA__ABA42564

SEQ ID NO: 152867 - RNA, 1701 nt, Artificial Sequence
  derived and/or modified sequence opt4 from hemagglutinin__InfluenzaA__ABA42928
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcauggugaacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152868 - RNA, 1701 nt, Artificial Sequence; identical to SEQ ID NO: 152592
  derived and/or modified sequence opt4 from hemagglutinin__InfluenzaA__ABA42939

SEQ ID NO: 152869 - RNA, 1701 nt, Artificial Sequence
  derived and/or modified sequence opt4 from hemagglutinin__InfluenzaA__ABA42978
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccauccccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152870 - RNA, 1701 nt, Artificial Sequence; identical to SEQ ID NO: 152763
  derived and/or modified sequence opt4 from hemagglutinin__InfluenzaA__ABA43167

SEQ ID NO: 152871 - RNA, 1701 nt, Artificial Sequence
  derived and/or modified sequence opt4 from hemagglutinin__InfluenzaA__ABA43178
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacaucugcaucuga

SEQ ID NO: 152872 - RNA, 1698 nt, Artificial Sequence
  derived and/or modified sequence opt4 from hemagglutinin__InfluenzaA__ABA43189
augaaggccaagcugcuggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152873 - RNA, 1701 nt, Artificial Sequence
  derived and/or modified sequence opt4 from hemagglutinin__InfluenzaA__ABA43200
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggugcuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152874 - RNA, 1701 nt, Artificial Sequence
  derived and/or modified sequence opt4 from hemagglutinin__InfluenzaA__ABA43336
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacguguggggcgugcaccaccccaucaccgacagagagcagaccaagcuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152875 - RNA, 1707 nt, Artificial Sequence
  derived and/or modified sequence opt4 from hemagglutinin__InfluenzaA__ABA54915
auggagaagguggugcugcugcuggccaccgccagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccagccccgccaacgaccugugcuaccccggcgacuucaacgacuacgaggagcugaagcaccugcugagcagaaucaaccacuucgagaagauccagaucauccccaagagcagcuggagcaaccacgaggccagcagcggcgugagcgccgccugccccuaccacggcaagcccagcuucuucagaaacgugguguggcugaucaagaagaacagcgccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacaccccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacaacaaggugagacugcagcugagagacaacgccaaggagcugggcaacggcugcuucgaguucuaccacaagugcgacaacgagugcauggagagcgugaagaacggcaccuacgacuacccccaguacagcgaggaggccagacugaacagagaggagaucagcggcgugaagcuggagagcaugggcaccuaccagauccugagcaucuacagcaccguggccagcagccuggcccuggccaucaugguggccggccugagccuguggaugugcagcaacggcagccugcagugcagaaucugcaucuga

SEQ ID NO: 152876 - RNA, 1698 nt, Artificial Sequence
  derived and/or modified sequence opt4 from hemagglutinin__InfluenzaA__ABA87080
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucaucgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaugggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152877 - RNA, 1698 nt, Artificial Sequence; identical to SEQ ID NO: 152816
  derived and/or modified sequence opt4 from hemagglutinin__InfluenzaA__ABA87091

SEQ ID NO: 152878 - RNA, 1698 nt, Artificial Sequence; identical to SEQ ID NO: 152816
  derived and/or modified sequence opt4 from hemagglutinin__InfluenzaA__ABA87231

SEQ ID NO: 152879 - RNA, 1701 nt, Artificial Sequence; identical to SEQ ID NO: 152775
  derived and/or modified sequence opt4 from hemagglutinin__InfluenzaA__ABA87242

SEQ ID NO: 152880 - RNA, 1701 nt, Artificial Sequence; identical to SEQ ID NO: 152776
  derived and/or modified sequence opt4 from hemagglutinin__InfluenzaA__ABA87253

SEQ ID NO: 152881 - RNA, 1698 nt, Artificial Sequence
  derived and/or modified sequence opt4 from hemagglutinin__InfluenzaA__ABB02781
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagagugugcaucuga

SEQ ID NO: 152882 - RNA, 1698 nt, Artificial Sequence; identical to SEQ ID NO: 152821
  derived and/or modified sequence opt4 from hemagglutinin__InfluenzaA__ABB02792

SEQ ID NO: 152883 - RNA, 1698 nt, Artificial Sequence; identical to SEQ ID NO: 152819
  derived and/or modified sequence opt4 from hemagglutinin__InfluenzaA__ABB02803

SEQ ID NO: 152884 - RNA, 1698 nt, Artificial Sequence
  derived and/or modified sequence opt4 from hemagglutinin__InfluenzaA__ABB02814
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152885 - RNA, 1698 nt, Artificial Sequence
  derived and/or modified sequence opt4 from hemagglutinin__InfluenzaA__ABB02825
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcgacaacgagugcauggagagcgugaagaacggcaccuacgacuaccccaaguacagcgaggagagcaagcugaacagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152886 - RNA, 1701 nt, Artificial Sequence
  derived and/or modified sequence opt4 from hemagglutinin__InfluenzaA__ABB02836
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaaaccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152887 - RNA, 1701 nt, Artificial Sequence
  derived and/or modified sequence opt4 from hemagglutinin__InfluenzaA__ABB02847
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaucggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152888 - RNA, 1701 nt, Artificial Sequence; identical to SEQ ID NO: 152567
  derived and/or modified sequence opt4 from hemagglutinin__InfluenzaA__ABB02858

SEQ ID NO: 152889 - RNA, 1701 nt, Artificial Sequence
  derived and/or modified sequence opt4 from hemagglutinin__InfluenzaA__ABB02869
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucguggagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152890 - RNA, 1701 nt, Artificial Sequence
  derived and/or modified sequence opt4 from hemagglutinin__InfluenzaA__ABB02880
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacagaaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152891 - RNA, 1701 nt, Artificial Sequence
  derived and/or modified sequence opt4 from hemagglutinin__InfluenzaA__ABB02891
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcgagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152892 - RNA, 1701 nt, Artificial Sequence
  derived and/or modified sequence opt4 from hemagglutinin__InfluenzaA__ABB02902
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152893 - RNA, 1698 nt, Artificial Sequence
  derived and/or modified sequence opt4 from hemagglutinin__InfluenzaA__ABB02913
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcacagaccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacagaaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152894 - RNA, 1698 nt, Artificial Sequence
  derived and/or modified sequence opt4 from hemagglutinin__InfluenzaA__ABB02924
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacgccgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152895 - RNA, 1698 nt, Artificial Sequence
  derived and/or modified sequence opt4 from hemagglutinin__InfluenzaA__ABB02936
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggccacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152896 - RNA, 1701 nt, Artificial Sequence
  derived and/or modified sequence opt4 from hemagglutinin__InfluenzaA__ABB02947
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcaggacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152897 - RNA, 1701 nt, Artificial Sequence; identical to SEQ ID NO: 152706
  derived and/or modified sequence opt4 from hemagglutinin__InfluenzaA__ABB02958

SEQ ID NO: 152898 - RNA, 1701 nt, Artificial Sequence; identical to SEQ ID NO: 152706
  derived and/or modified sequence opt4 from hemagglutinin__InfluenzaA__ABB02969

SEQ ID NO: 152899 - RNA, 1701 nt, Artificial Sequence
  derived and/or modified sequence opt4 from hemagglutinin__InfluenzaA__ABB02980
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152900 - RNA, 1701 nt, Artificial Sequence
  derived and/or modified sequence opt4 from hemagglutinin__InfluenzaA__ABB02991
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacaacccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152901 - RNA, 1701 nt, Artificial Sequence
  derived and/or modified sequence opt4 from hemagglutinin__InfluenzaA__ABB03002
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152902 - RNA, 1701 nt, Artificial Sequence
  derived and/or modified sequence opt4 from hemagglutinin__InfluenzaA__ABB03013
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccggcaccgacagcgaccagaccagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152903 - RNA, 1701 nt, Artificial Sequence
  derived and/or modified sequence opt4 from hemagglutinin__InfluenzaA__ABB03024
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccuggaucagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152904 - RNA, 1701 nt, Artificial Sequence
  derived and/or modified sequence opt4 from hemagglutinin__InfluenzaA__ABB03035
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacguggccaugcccaacaacgacaaguucgacaagcuguacaucuggggcgugcaccaccccggcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucaccgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcguggugcugcugggcuucaucaugugggccugccagaagggcaacaucagaugcaacaucugcaucuga

SEQ ID NO: 152905 - RNA, 1701 nt, Artificial Sequence
  derived and/or modified sequence opt4 from hemagglutinin__InfluenzaA__ABB03046
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcggcaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152906 - RNA, 1701 nt, Artificial Sequence
  derived and/or modified sequence opt4 from hemagglutinin__InfluenzaA__ABB03057
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagcugggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152907 - RNA, 1701 nt, Artificial Sequence; identical to SEQ ID NO: 152806
  derived and/or modified sequence opt4 from hemagglutinin__InfluenzaA__ABB03068

SEQ ID NO: 152908 - RNA, 1701 nt, Artificial Sequence; identical to SEQ ID NO: 152763
  derived and/or modified sequence opt4 from hemagglutinin__InfluenzaA__ABB03079

SEQ ID NO: 152909 - RNA, 1701 nt, Artificial Sequence; identical to SEQ ID NO: 152763
  derived and/or modified sequence opt4 from hemagglutinin__InfluenzaA__ABB03090

SEQ ID NO: 152910 - RNA, 1698 nt, Artificial Sequence
  derived and/or modified sequence opt4 from hemagglutinin__InfluenzaA__ABB03101
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaagaagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgagaccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152911 - RNA, 1701 nt, Artificial Sequence
  derived and/or modified sequence opt4 from hemagglutinin__InfluenzaA__ABB03112
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacaccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152912 - RNA, 1698 nt, Artificial Sequence
  derived and/or modified sequence opt4 from hemagglutinin__InfluenzaA__ABB03123
augaaggugaagcugcuggugcugcugugcaccuucaccgccaccuacgccgacaccaucugcaucggcuaccacgccaacaacagcaccgacaccguggacaccgugcuggagaagaacgugaccgugacccacuucgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152913 - RNA, 1698 nt, Artificial Sequence
  derived and/or modified sequence opt4 from hemagglutinin__InfluenzaA__ABB03134
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccacccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152914 - RNA, 1698 nt, Artificial Sequence; identical to SEQ ID NO: 152819
  derived and/or modified sequence opt4 from hemagglutinin__InfluenzaA__ABB03145

SEQ ID NO: 152915 - RNA, 1701 nt, Artificial Sequence
  derived and/or modified sequence opt4 from hemagglutinin__InfluenzaA__ABB04283
augaagaccaucaucgcccugagcuacaucuucugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgacaagagcuucuucagcagacugaacuggcuguacgagagcgagagcaaguaccccgcccugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggccccagacccugggugagaggccugagcagcagaaucagcaucuacuggaccaucgugaagcccggcgacauccugcugaucaacagcagcggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152916 - RNA, 1701 nt, Artificial Sequence
  derived and/or modified sequence opt4 from hemagglutinin__InfluenzaA__ABB04294
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152917 - RNA, 1701 nt, Artificial Sequence
  derived and/or modified sequence opt4 from hemagglutinin__InfluenzaA__ABB04305
augaagaccaucaucgcccugagcuacaucuucugccugguguucgcccagaagcugcccgagaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacaagagcgagagcaaguaccccgugcugaacgugaccaugcccaacaacggcaaguucgacaagcuguacaucuggggcgugcaccaccccagcaccgacaaggagcagaccaaccuguacgugagagccagcggcaaggugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152918 - RNA, 1701 nt, Artificial Sequence
  derived and/or modified sequence opt4 from hemagglutinin__InfluenzaA__ABB04316
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaagagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggugcugcugggcuucaucaugugggccugccagaagggcaacaucagaugcaacaucugcaucuga

SEQ ID NO: 152919 - RNA, 1701 nt, Artificial Sequence
  derived and/or modified sequence opt4 from hemagglutinin__InfluenzaA__ABB04327
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacaagagcgaguacaaguaccccgcccugaacgugaccaugcccaacaacggcaaguucgacaagcuguacaucuggggcgugcaccaccccagcaccgagaaggagcagaccaaccuguacgugagagccagcggcagagugaccgugagcaccaagagaagccagcagaccgugauccccaacaucggcagcauccccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152920 - RNA, 1701 nt, Artificial Sequence
  derived and/or modified sequence opt4 from hemagglutinin__InfluenzaA__ABB04338
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugcugaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152921 - RNA, 1701 nt, Artificial Sequence
  derived and/or modified sequence opt4 from hemagglutinin__InfluenzaA__ABB04349
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacaagagcgagagcaaguaccccgugcugaacgugaccaugcccaacaacggcaaguucgacaagcuguacaucuggggcgugcaccaccccagcaccgacaaggagcagaccaaccuguacgugagagccagcggcaaggugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcaacagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152922 - RNA, 1701 nt, Artificial Sequence
  derived and/or modified sequence opt4 from hemagglutinin__InfluenzaA__ABB04360
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152923 - RNA, 1701 nt, Artificial Sequence
  derived and/or modified sequence opt4 from hemagglutinin__InfluenzaA__ABB04371
augaagaccaucaucgcccugagcuacaucuucuaccuggcccugggccaggaccugcccggcaacgacaacagcaaggccacccugugccugggccaccacgccgugcccaacggcacccuggugaagaccaucaccgacgaccagaccgaggugaccaacgccaccgagcuggugcagagcagcagcaccggcaagaucugcaacaacccccacagaauccuggacggcauggacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcaccauggaguucaucaccgagggcuucaccuggaccgaggugacccagaacggcggcagcaacgccugcaagagaggccccgacagcggcuucuucagcagacugaacuggcugaccaagagcggcagaaccuaccccgugcugaacgugaccaugcccaacaacgacaacuucgacaagcuguacaucuggggcgugcaccaccccagcaccgaccaggagcagaccaaccuguacgugcagaccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 152924 - RNA, 1701 nt, Artificial Sequence
  derived and/or modified sequence opt4 from hemagglutinin__InfluenzaA__ABB04906
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagaacggcgacagcuacgccugcaagagaggcagcgugaagagcuucuucagcagacugaacuggcugcacaagagcgaguacaaguaccccgcccugaacgugaccaugcccaacaacgacaaguucgacaagcuguacaucuggggcgugcaccaccccagcaccgacagagagcagaccagccuguacaucagagccagcggcaaggugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152925 - RNA, 1701 nt, Artificial Sequence
  derived and/or modified sequence opt4 from hemagglutinin__InfluenzaA__ABB04917
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaucagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacaccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152926 - RNA, 1701 nt, Artificial Sequence
  derived and/or modified sequence opt4 from hemagglutinin__InfluenzaA__ABB04928
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaucggcgugacccagaacggcggcagcaacgccugcaagagaggcaccgacagcggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152927 - RNA, 1701 nt, Artificial Sequence
  derived and/or modified sequence opt4 from hemagglutinin__InfluenzaA__ABB04939
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacaccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaucggcaaccugaucgcccccagaggcuacuucaagaucagaaccggcaagagcagcaucaugagaagcgacgcccccaucggcaucugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccguggaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152928 - RNA, 1701 nt, Artificial Sequence
  derived and/or modified sequence opt4 from hemagglutinin__InfluenzaA__ABB04950
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacaccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcaaggugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152929 - RNA, 1701 nt, Artificial Sequence
  derived and/or modified sequence opt4 from hemagglutinin__InfluenzaA__ABB04983
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccgacagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 152930 - RNA, 1701 nt, Artificial Sequence; identical to SEQ ID NO: 152692
  derived and/or modified sequence opt4 from hemagglutinin__InfluenzaA__ABB04994

SEQ ID NO: 152931 - RNA, 1701 nt, Artificial Sequence
  derived and/or modified sequence opt4 from hemagglutinin__InfluenzaA__ABB05005
augaagaccaucaucgcccugagccacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccgacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcgugcccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152932 - RNA, 1701 nt, Artificial Sequence
  derived and/or modified sequence opt4 from hemagglutinin__InfluenzaA__ABB05183
augaagaccaucaucgcccugagcuacauccugugccugguguucgcccagaagcugcccgugaacgacaacagcaccgccacccugugccugggccaccacgccgugcccaacggcacccuggugaagaccaucaccaacgagcacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagguguaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152933 - RNA, 1701 nt, Artificial Sequence
  derived and/or modified sequence opt4 from hemagglutinin__InfluenzaA__ABB05194
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaucaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcgugaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152934 - RNA, 1701 nt, Artificial Sequence
  derived and/or modified sequence opt4 from hemagglutinin__InfluenzaA__ABB05205
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaacgccuacagcaacugcuaccccuacgacgugcccgacuacgccagccugagaagccugguggccagcagcggcacccuggaguucaacagcgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacaacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152935 - RNA, 1701 nt, Artificial Sequence; identical to SEQ ID NO: 152592
  derived and/or modified sequence opt4 from hemagglutinin__InfluenzaA__ABB05216

SEQ ID NO: 152936 - RNA, 1701 nt, Artificial Sequence
  derived and/or modified sequence opt4 from hemagglutinin__InfluenzaA__ABB46392
augaagaccaucaucgcccugagcuacaucuucugccuggccuucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccaacaccgacaaggagcagaccgaccuguacgugcaggccagcggcaaggugaccgugagcaccaagagaagccagcagaccaucauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccagaccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152937 - RNA, 1701 nt, Artificial Sequence
  derived and/or modified sequence opt4 from hemagglutinin__InfluenzaA__ABB46414
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccuguucugcguggugcugcugggcuucaucaugugggccugccagaagggcaacaucagaugcaacaucugcaucuga

SEQ ID NO: 152938 - RNA, 1701 nt, Artificial Sequence
  derived and/or modified sequence opt4 from hemagglutinin__InfluenzaA__ABB46425
augaagaccaucaucgcccugagcuacauccugugccugguguucgcccagaagcugcccggcaacgacaacagcaccgccacccugugccugggccaccacgccgugcccaacggcacccuggugaagaccaucaccagcgaccagaucgaggugaccaacgccaccgagcuggugcagagcagcagcaccggcaagaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuucgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152939 - RNA, 1701 nt, Artificial Sequence
  derived and/or modified sequence opt4 from hemagglutinin__InfluenzaA__ABB46436
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguacgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152940 - RNA, 1701 nt, Artificial Sequence; identical to SEQ ID NO: 152873
  derived and/or modified sequence opt4 from hemagglutinin__InfluenzaA__ABB46447

SEQ ID NO: 152941 - RNA, 1701 nt, Artificial Sequence
  derived and/or modified sequence opt4 from hemagglutinin__InfluenzaA__ABB46458
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaaaccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaagagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucauguggggcugccagaagggcaacaucagaugcaacaucugcaucuga

SEQ ID NO: 152942 - RNA, 1701 nt, Artificial Sequence
  derived and/or modified sequence opt4 from hemagglutinin__InfluenzaA__ABB51961
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcuucagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccugcgugagaagccugguggccagcagcggcacccuggaguucaacaacgagagcuucaacugggccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcacccagagaugcaagcagcuggugauccccaacaucggcagcagacccagagugagagacgugagcagcagaaucagcaucuacuggaccaucgugaaccccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152943 - RNA, 1698 nt, Artificial Sequence
  derived and/or modified sequence opt4 from hemagglutinin__InfluenzaA__ABB51962
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgccaugagcagaggcuucggcagcggcaucagcaccagcaacgcccccaugggcgagugcgacgccaaguuccagaccccccagggcggcaucaacaucagccugcccuuccagaacgugcaccccgugaccaucggcgagugccccaacuacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcagcgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152944 - RNA, 1701 nt, Artificial Sequence
  derived and/or modified sequence opt4 from hemagglutinin__InfluenzaA__ABB51963
augaagaccaucaucgcccugagcuacauccugugccugguguucgcccagaagcugcccggcaacgacaacagcaccgccacccugugccugggccaccacgccgugcccaacggcaccaucgugaagaccaucaccaacgacagaaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagacacauccccagcagaaucagcaucuacuggaccaucgugaaccccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaacagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacgagaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagguguaccacaagugcgacaacgccugcaucggcagcaucagaaacggcaccuacgaccacaacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152945 - RNA, 1701 nt, Artificial Sequence; identical to SEQ ID NO: 152802
  derived and/or modified sequence opt4 from Hemagglutinin__InfluenzaA__ABB51964

SEQ ID NO: 152946 - RNA, 1698 nt, Artificial Sequence
  derived and/or modified sequence opt4 from hemagglutinin__InfluenzaA__ABB53603
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaagaagaaggaggugcugauccuguggggcgugcaccacccccccaacaucggcaaccagagaacccuguacuacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152947 - RNA, 1701 nt, Artificial Sequence; identical to SEQ ID NO: 152775
  derived and/or modified sequence opt4 from hemagglutinin__InfluenzaA__ABB53614

SEQ ID NO: 152948 - RNA, 1701 nt, Artificial Sequence; identical to SEQ ID NO: 152775
  derived and/or modified sequence opt4 from hemagglutinin__InfluenzaA__ABB53625

SEQ ID NO: 152949 - RNA, 1701 nt, Artificial Sequence; identical to SEQ ID NO: 152802
  derived and/or modified sequence opt4 from hemagglutinin__InfluenzaA__ABB53652

SEQ ID NO: 152950 - RNA, 1701 nt, Artificial Sequence
  derived and/or modified sequence opt4 from hemagglutinin__InfluenzaA__ABB53663
augaagaccaucuucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaacuucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152951 - RNA, 1701 nt, Artificial Sequence; identical to SEQ ID NO: 152775
  derived and/or modified sequence opt4 from hemagglutinin__InfluenzaA__ABB53685

SEQ ID NO: 152952 - RNA, 1701 nt, Artificial Sequence
  derived and/or modified sequence opt4 from hemagglutinin__InfluenzaA__ABB53696
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgcccugcugggcuucaucaugugggccugccagaagggcaacaucagaugcaacgugugcaucuga

SEQ ID NO: 152953 - RNA, 1698 nt, Artificial Sequence; identical to SEQ ID NO: 152816
  derived and/or modified sequence opt4 from hemagglutinin__InfluenzaA__ABB53707

SEQ ID NO: 152954 - RNA, 1701 nt, Artificial Sequence; identical to SEQ ID NO: 152763
  derived and/or modified sequence opt4 from hemagglutinin__InfluenzaA__ABB53718

SEQ ID NO: 152955 - RNA, 1698 nt, Artificial Sequence
  derived and/or modified sequence opt4 from hemagglutinin__InfluenzaA__ABB53740
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaugggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgagaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152956 - RNA, 1701 nt, Artificial Sequence
  derived and/or modified sequence opt4 from hemagglutinin__InfluenzaA__ABB53751
augaagaccaucaucgcccugagcuacaucagcugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgacaacagcuucuucagcagacugaacuggcuguacaagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcggcaucagcaucuacuggaccaucgugaagcccggcgacauccugcugaucaacagcaacggcaaccugaucgcccccagaggcuacuucaagaucagaaccggcaagagcagcauccugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152957 - RNA, 1701 nt, Artificial Sequence
  derived and/or modified sequence opt4 from hemagglutinin__InfluenzaA__ABB60007
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccgacagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152958 - RNA, 1701 nt, Artificial Sequence
  derived and/or modified sequence opt4 from hemagglutinin__InfluenzaA__ABB77853
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccgacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152959 - RNA, 1701 nt, Artificial Sequence
  derived and/or modified sequence opt4 from hemagglutinin__InfluenzaA__ABB79731
augaagaccaucaucgcccugagcuacauccugugccugguguucgcccaggagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaccagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152960 - RNA, 1701 nt, Artificial Sequence
  derived and/or modified sequence opt4 from hemagglutinin__InfluenzaA__ABB79788
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccaucaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152961 - RNA, 1701 nt, Artificial Sequence
  derived and/or modified sequence opt4 from hemagglutinin__InfluenzaA__ABB79799
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcaaggugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152962 - RNA, 1701 nt, Artificial Sequence
  derived and/or modified sequence opt4 from hemagglutinin__InfluenzaA__ABB79810
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagacugugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcagaagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccagagcagcagaaucagcaucuacuggaccaucgugaagcccggcgacauccugcugaucgacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagcacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152963 - RNA, 1701 nt, Artificial Sequence
  derived and/or modified sequence opt4 from hemagglutinin__InfluenzaA__ABB79957
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagacugugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcagaagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccagagcagcagaaucggcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagcacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152964 - RNA, 1701 nt, Artificial Sequence
  derived and/or modified sequence opt4 from hemagglutinin__InfluenzaA__ABB79968
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagacugugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcagaagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccagagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagcacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152965 - RNA, 1698 nt, Artificial Sequence
  derived and/or modified sequence opt4 from hemagglutinin__InfluenzaA__ABB79979
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuaccacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152966 - RNA, 1698 nt, Artificial Sequence
  derived and/or modified sequence opt4 from hemagglutinin__InfluenzaA__ABB79990
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152967 - RNA, 1701 nt, Artificial Sequence
  derived and/or modified sequence opt4 from hemagglutinin__InfluenzaA__ABB80001
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagagcacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 152968 - RNA, 1701 nt, Artificial Sequence; identical to SEQ ID NO: 152763
  derived and/or modified sequence opt4 from hemagglutinin__InfluenzaA__ABB80012

SEQ ID NO: 152969 - RNA, 1701 nt, Artificial Sequence
  derived and/or modified sequence opt4 from hemagglutinin__InfluenzaA__ABB80023
augaagaccaucaucgcccugagcuacaucuucuaccuggcccugggccaggaccugcccggcaacgacaacagcaaggccacccugugccugggccaccacgccgugcccaacggcacccuggugaagaccaucaccaacgaccagaccgaggugaccaacgccaccgagcuggugcagagcagcagcaccggcaagaucugcaacaacccccacagaauccuggacggcauggacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccgaggugacccagaacggcggcagcaacgccugcaagagaggccccgacagcggcuucuucagcagacugaacuggcugaccaagagcggcagaaccuaccccgugcugaacgugaccaugcccaacaacgacaacuucgacaagcuguacaucuggggcgugcaccaccccagcaccgaccaggagcagaccaaccuguacgugcagaccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcaggacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 152970 - RNA, 1701 nt, Artificial Sequence
  derived and/or modified sequence opt4 from hemagglutinin__InfluenzaA__ABB80034
augaagaccaucaucgcccugagcuacaucuucugccuggugcugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggccuggacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgccaccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 152971 - RNA, 1698 nt, Artificial Sequence; identical to SEQ ID NO: 152884
  derived and/or modified sequence opt4 from hemagglutinin__InfluenzaA__ABB80045

SEQ ID NO: 152972 - RNA, 1701 nt, Artificial Sequence
  derived and/or modified sequence opt4 from hemagglutinin__InfluenzaA__ABB80081
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152973 - RNA, 1701 nt, Artificial Sequence
  derived and/or modified sequence opt4 from hemagglutinin__InfluenzaA__ABB80092
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggacccuggugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152974 - RNA, 1701 nt, Artificial Sequence; identical to SEQ ID NO: 152775
  derived and/or modified sequence opt4 from hemagglutinin__InfluenzaA__ABB80137

SEQ ID NO: 152975 - RNA, 1701 nt, Artificial Sequence; identical to SEQ ID NO: 152972
  derived and/or modified sequence opt4 from hemagglutinin__InfluenzaA__ABB80159

SEQ ID NO: 152976 - RNA, 1701 nt, Artificial Sequence; identical to SEQ ID NO: 152543
  derived and/or modified sequence opt4 from hemagglutinin__InfluenzaA__ABB80185

SEQ ID NO: 152977 - RNA, 1701 nt, Artificial Sequence
  derived and/or modified sequence opt4 from hemagglutinin__InfluenzaA__ABB80207
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 152978 - RNA, 1701 nt, Artificial Sequence
  derived and/or modified sequence opt4 from hemagglutinin__InfluenzaA__ABB80229
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 152979 - RNA, 1701 nt, Artificial Sequence; identical to SEQ ID NO: 152972
  derived and/or modified sequence opt4 from hemagglutinin__InfluenzaA__ABB80240

SEQ ID NO: 152980 - RNA, 1701 nt, Artificial Sequence
  derived and/or modified sequence opt4 from hemagglutinin__InfluenzaA__ABB80251
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggccugaucaugugggccugccagaagggcaacaucagaugcaacaucugcaucuga

SEQ ID NO: 152981 - RNA, 1701 nt, Artificial Sequence
  derived and/or modified sequence opt4 from hemagglutinin__InfluenzaA__ABB80492
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 152982 - RNA, 1701 nt, Artificial Sequence
  derived and/or modified sequence opt4 from hemagglutinin__InfluenzaA__ABB80503
augaagaccaucaucgcccugagcuacaucagcugccugguguucgcccagaagcugcccggcaacgacaacaacaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugagaagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152983 - RNA, 1701 nt, Artificial Sequence; identical to SEQ ID NO: 152972
  derived and/or modified sequence opt4 from hemagglutinin__InfluenzaA__ABB80514

SEQ ID NO: 152984 - RNA, 1701 nt, Artificial Sequence
  derived and/or modified sequence opt4 from hemagglutinin__InfluenzaA__ABB80529
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgacaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152985 - RNA, 1701 nt, Artificial Sequence
  derived and/or modified sequence opt4 from hemagglutinin__InfluenzaA__ABB80641
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugagcgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152986 - RNA, 1701 nt, Artificial Sequence
  derived and/or modified sequence opt4 from hemagglutinin__InfluenzaA__ABB80661
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccaggccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152987 - RNA, 1701 nt, Artificial Sequence
  derived and/or modified sequence opt4 from hemagglutinin__InfluenzaA__ABB80672
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagggcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152988 - RNA, 1701 nt, Artificial Sequence
  derived and/or modified sequence opt4 from hemagglutinin__InfluenzaA__ABB80682
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcugcuggagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152989 - RNA, 1701 nt, Artificial Sequence
  derived and/or modified sequence opt4 from hemagglutinin__InfluenzaA__ABB80693
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaugugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152990 - RNA, 1701 nt, Artificial Sequence
  derived and/or modified sequence opt4 from hemagglutinin__InfluenzaA__ABB80704
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152991 - RNA, 1701 nt, Artificial Sequence; identical to SEQ ID NO: 152972
  derived and/or modified sequence opt4 from hemagglutinin__InfluenzaA__ABB80715

SEQ ID NO: 152992 - RNA, 1701 nt, Artificial Sequence
  derived and/or modified sequence opt4 from hemagglutinin__InfluenzaA__ABB80724
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccaggccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 152993 - RNA, 1701 nt, Artificial Sequence; identical to SEQ ID NO: 152978
  derived and/or modified sequence opt4 from hemagglutinin__InfluenzaA__ABB80737

SEQ ID NO: 152994 - RNA, 1701 nt, Artificial Sequence
  derived and/or modified sequence opt4 from hemagglutinin__InfluenzaA__ABB80748
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcacccagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggaggaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152995 - RNA, 1701 nt, Artificial Sequence
  derived and/or modified sequence opt4 from hemagglutinin__InfluenzaA__ABB82183
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcgugaugagaagcgacgccagcaucggcagaugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 152996 - RNA, 1698 nt, Artificial Sequence; identical to SEQ ID NO: 152816
  derived and/or modified sequence opt4 from hemagglutinin__InfluenzaA__ABB82194

SEQ ID NO: 152997 - RNA, 1698 nt, Artificial Sequence
  derived and/or modified sequence opt4 from hemagglutinin__InfluenzaA__ABB82205
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacagcaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152998 - RNA, 1698 nt, Artificial Sequence
  derived and/or modified sequence opt4 from hemagglutinin__InfluenzaA__ABB82216
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcagcagcugcagccacaacggcaagagcagcuucuacagaaaccugcuguggcugaccggcaagaacggccuguaccccaaccugagcaagagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 152999 - RNA, 1701 nt, Artificial Sequence
  derived and/or modified sequence opt4 from hemagglutinin__InfluenzaA__ABB82227
augaagaccaucaucgcccugagcuacaucuucugccugacccugggccaggaccugcccggcaacgacaacagcaaggccacccugugccugggccaccacgccgugcccaacggcacccuggugaagaccaucaccgacgaccagaccgaggugaccaacgccaccgagcuggugcagagcagcagcaccggcaagaucugcaacaacccccacagaauccuggacggcauggacugcacccugaucgacgcccugcugggcgacccccacugcgacguguuccagaacgagaccugggaccuguucguggagagaagcaaggccuucagcaacugcuaccccuacgacgugcccgacuacgccagccugagaagccuggccgccagcagcggcacccuggaguucaucaccgagggcuucaccuggaccggcgugacccagaacggcggcagcaacgccugcaagagaggccccggcagcggcuucuucagcagacugaacuggcugaccaagagcggcaacaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacaucaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggccauggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 153000 - RNA, 1698 nt, Artificial Sequence
  derived and/or modified sequence opt4 from hemagglutinin__InfluenzaA__ABB83026
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153001 - RNA, 1698 nt, Artificial Sequence
  derived and/or modified sequence opt4 from hemagglutinin__InfluenzaA__ABB83127
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153002 - RNA, 1698 nt, Artificial Sequence
  derived and/or modified sequence opt4 from hemagglutinin__InfluenzaA__ABB83138
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcaucagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153003 - RNA, 1701 nt, Artificial Sequence
  derived and/or modified sequence opt4 from hemagglutinin__InfluenzaA__ABB86877
augaaggccauccugcugauccugcuguacaccuucaccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaaccugggcggcaucgccccccuguaccugggcaacugcaacaucgccggcuggcugcugggcaaccccgagugcgagcugcuguucaccgugagcagcuggagcuacaucguggagaccagcaacagcgacaacggcaccugcuaccccggcgacuucaucaacuacgaggagcugagagagcagcugagcagcaugagcagcuacgagagauucgagaucuuccccaaggagagcagcuggcccaaccacgagaccaacagaggcgugaccgccgccugccccuacgccggcgccaacagcuucuacagaaaccugaucuggcuggugaagaagggcaacagcuaccccaagaucaacaagagcuacgugaacaacaaggagaaggaggugcuggugcuguggggcauccaccacccccccaccagcgccgaccagcagagccuguaccagaacgccgacgccuacgugagcguggagagcagcaaguacaacaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaacagaggcagcggcagcggcaucaucaucagcgacacccccgugcacgacugcaacaccaccugccagacccccaagggcgccaucaacaccagccugcccuuccagaacgugcaccccgugaccaucggcgagugccccaaguacgugaagagcaccaagcugagaauggccaccggccugagaaacauccccagcauccagagcagaggccuguucgaggccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugagaaacggcaccuacgacuaccugaaguacagcgaggagagcaagcugaacagagagaagaucgagggcgugaagcuggacagcgccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 153004 - RNA, 1701 nt, Artificial Sequence
  derived and/or modified sequence opt4 from hemagglutinin__InfluenzaA__ABB86887
augaaggccauccugcugauccugcuguacaccuucaccgccaccaacgccgacacccugugcaucggcuaccacgccaacaacagcaccgacaccguggacaccgugcuggagaagaacgugaccgugacccacagcgugaaccugcuggaggacagacacaacggcaagcugugcaaccugggcggcaucgccccccuguaccugggcaacugcaacaucgccggcuggcugcugggcaaccccgagugcgagcugcuguucaccgugagcagcuggagcuacaucguggagaccagcaacagcgacaacggcaccugcuaccccggcgacuucaucaacuacgaggagcugagagagcagcugagcagcaugagcagcuacgagagauucgagaucuuccccaaggagagcagcuggcccaaccacgagaccaacagaggcgugaccgccgccugccccuacgccggcgccaacagcuucuacagaaaccugaucuggcuggugaagaagggcaacagcuaccccaagaucaacaagagcuacgugaacaacaaggagaaggaggugcuggugcuguggggcauccaccacccccccaccagcgccgaccagcagagccuguaccagaacgccgacgccuacgugagcguggagagcagcaaguacaacaagaaguucaagcccgagaucgccaccagacccaaggugagaggccaggccggcagaaugaacuacuacuggacccugguggagcccggcgacaccaucaccuucgaggccaccggcaaccugguggugcccagauacgccuucgccaugaagagaggcagcggcagcggcaucaucaucagcgacacccccgugcacgacugcaacaccaccugccagacccccaagggcgccaucaacaccagccugcccuuccagaacauccaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacagaaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagccagcugagaaacaacgccaaggagaucggcaacggcugcuucgaguucuaccacaagugcgacgacaccugcauggagagcgugagaaacggcaccuacgacuaccugaaguacagcgaggagagcaagcugaacagagagaagaucgagggcgugaagcuggacagcgccagaaucuaccagauccuggccaucuacagcaccguggccagcagccuggugcugcuggugagccugggcgccaucagcuucuggaugugcagcaacggcagccugcagugcagaaucugcaucuga

SEQ ID NO: 153005 - RNA, 1698 nt, Artificial Sequence
  derived and/or modified sequence opt4 from hemagglutinin__InfluenzaA__ABB86899
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggccacuucgccgacuacgaggagcugagagagcagcugagcagcgugagcagcuucgagagauucgagaucuuccccaaggagagcagcuggcccaaccacaccaucaccggcgugagcgccagcugcagccacaacggcaagagaagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagggccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccugauccugcuggugagccugggcgccaucagcuucuggaugugcagcaacggcagccugcagugcagaaucugcaucuga

SEQ ID NO: 153006 - RNA, 1701 nt, Artificial Sequence
  derived and/or modified sequence opt4 from hemagglutinin__InfluenzaA__ABB86907
augaaggccauccugcuggugcugcuguacaccuucaccagcaccaacgccgacacccugugcaucggcuaccacgccaacaacagcaccgacaccguggacaccgugcuggagaagaacgugaccgugacccacagcgugaaccugcuggaggacaagcacaacggcaagcugugcagacugggcggcaucgccccccugcaccugggcaagugcaacaucgccggcuggcugcugggcaaccccgagugcgaccugcugcugaccgugagcagcuggagcuacaucguggagaccagcaacagcuacaacggcaccugcuaccccggcgacuucaccaacuacgaggagcugagagagcagcugagcagcgugagcagcuucgagagauucgagaucuuccccaaggccagcagcuggcccaaccacgagaccaacagaggcgugaccgccgccugcccccacgccggcaccaacagcuucuacagaaaccugaucuggcuggugaagaagggcaacaccuaccccaagcugagcaagagcuacgugaacaacaagggcaaggaggugcuggugcuguggggcauccaccaccccagcaccagcaccgaccagcagagccuguaccagaacgccgacaccuacguguucgugggcaccagcaaguacaacaagaaguucaagcccgagaucgccgugagacccaaggugaaggaccaggccggcagaaugaacuacuacuggacccugguggagcccggcgacaccaucaccuucgaggccaccggcaaccugguggugcccagauacgccuucgccaugaacagaggccacggcagcggcaucaucaucagcgacacccccgugcacgacugcaacaccaccugccagacccccaagggcgccaucaacaccagccugcccuuccagaacgugcaccccgugaccaucggcaagugccccaaguacgugaagagcaccagacugagaauggccaccggccugagaaacauccccagcauccagagcagaggccuguucggcgccaucgccggcuucaucgagggcggcuggaccggcaugaucgacggcugguacggcuaccaccaccagaacggccagggcagcggcuacgccgccgaccagaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagacagcugaagaacaacgccaaggagaucggcaacggcugcuucgaguucuaccacaacugcgacgacgccugcauggagagcgugaagaacggcaccuacgacuaccccaaguacagcgaggagagcagacugaacagagaggagaucaacggcaucaagcuggacagcaccagaaucuaccagauccuggccaucuacagcaccguggccagcagcagcgugcugcuggugagccugggcgccaucagcuucuggaugugcagcaacggcagccugcagugcagaaucugcaucuga

SEQ ID NO: 153007 - RNA, 1698 nt, Artificial Sequence
  derived and/or modified sequence opt4 from hemagglutinin__InfluenzaA__ABB86917
augaaggugaagcugcugauccugcugugcaccuucaccgccaccuacgccgaccccaucugcaucggcuaccacgccaacaacagcaccgacaccguggacaccgugcuggagaagaacguggccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153008 - RNA, 1698 nt, Artificial Sequence
  derived and/or modified sequence opt4 from hemagglutinin__InfluenzaA__ABB86929
augaaggugaagcugcugauccugcuguacaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggccacuucgccgacuacgaggagcugagagagcagcugagcagcgugagcagcuucgagagauucgagaucuuccccaaggagagcagcuggcccaaccacaccaucaccggcgugagcgccagcugcagccacaacggcaagagaagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagggccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccugauccugcuggugagccugggcgccaucagcuucuggaugugcagcaacggcagccugcagugcagaaucugcaucuga

SEQ ID NO: 153009 - RNA, 1701 nt, Artificial Sequence
  derived and/or modified sequence opt4 from hemagglutinin__InfluenzaA__ABB86937
augaaggccauccugcuggugcugcuguacaccuucaccagcaccaacgccgacacccugugcaucggcuaccacgccaacaacagcaccgacaccguggacaccgugcuggagaagaacgugaccgugacccacagcgugaaccugcuggaggacaagcacaacggcagacugugcaagcugggcggcaucgccccccugcaccugggcaagugcaacaucgccggcuggcugcugggcaaccccgagugcgagcugcuguucaccgugagcagcuggagcuacaucguggagaccagcaacagcuacaacggcaccugcuaccccggcgacuucaucaacuacgaggagcugagagagcagcugagcagcgugagcagcuucgagagauucgagaucuuccccaaggccagcagcuggcccaaccacgagaccaacagaggcgugaccgccgccugcccccacgccggcaccaacagcuucuacagaaaccugaucuggcuggugaagaagggcaacaccuaccccaagaucagcaagagcuacgugaacaacaagggcaaggaggugcuggugcuguggggcauccaccaccccagcaccagcaacgaccagcagagccuguaccagaacgccgacaccuacguguucgugggccccagcaaguacaacaagaaguucaagcccgagaucgccaccagacccaaggugagagaccaggccggcagaaugaacuacuacuggacccugguggagcccggcgacaccaucaccuucgaggccaccggcaaccugguggugcccagauacgccuucgccaugaacagaggcagcgagagcggcaucaucaucagcgacacccccgugcacgacugcaacaccaccugccagacccccaagggcgccaucaacaccagccugcccuuccagaacgugcaccccgugaccaucggcgagugccccaaguacgugaagagcaccagacugagaauggccaccggccugagaaacauccccagcauccagagcagaggccuguucggcgccaucgccggcuucaucgaggagggcuggaccggcaugaucgacggcugguacggcuaccaccaccagaacggccagggcagcggcuacgccgccgaccagaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagacagcugaagaacaacgccaaggagaucggcaacggcugcuucgaguucuaccacaagugcgacgacgccugcauggagagcgugaagaacggcaccuacgacuaccccaaguacagcgaggagagcagacugaacagagaggagaucaacggcaucaagcuggacagcaccagaaucuaccagauccuggccaucuacagcaccguggccagcagcagcgugcugcuggugagccugggcgccaucagcuucuggaugugcagcaacggcagccugcagugcagaaucugcaucuga

SEQ ID NO: 153010 - RNA, 1701 nt, Artificial Sequence
  derived and/or modified sequence opt4 from hemagglutinin__InfluenzaA__ABB86946
augaaggccauccugcuggugcugcuguacaccuucaccgccgccaacgccgacacccugugcaucggcuaccacgccaacaacagcaccgacaccguggacaccgugcuggagaagaacgugaccgugacccacagcgugaaccugcuggaggacagacacaacggcaagcugugcaagcugagaggcaucgccccccugcaccugggcaagugcaacaucgccggcuggcugcugggcaaccccgagugcgagagccugagcaccgugagcagcuggagcuacaucguggagaccagcaacagcgacaacggcaccugcuaccccggcgacuucaucaacuacgaggagcugagagagcagcugagcagcgugagcagcuucgagagauucgagaucuuccccaaggccagcagcuggcccaaccacgagaccaacagaggcaccaccgccgccugccccuacgccggcgccaacagcuucuacagaaaccugaucuggcuggugaagaagggcaacagcuaccccaagcugaacaagagcuacgugaacaacaagggcaaggaggugcuggugcuguggggcauccaccaccccagcaccagcaacgagcagcagagccuguaccagaacgccgacaccuacguguucgugggcagcagcaaguacaacaagaaguucaagcccgagaucgccaccagacccaaggugagagaccaggccggcagaaugaacuacuacuggacccugaucgagcccggcgacaccaucaccuucgaggccaccggcaaccugguggugcccagauacgccuucgccaugaacagaggcagcggcagcggcaucaucaucagcgacacccccgugcacgacugcaacaccaccugccagacccccaagggcgccaucaacaccagccugcccuuccagaacgugcaccccgugaccaucggcgagugccccaaguacgugaagagcaccaagcugagaauggccaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaaccaccuggagaagagaaucgagaaccugaacaagaagguggacgacggcuuccuggacguguggaccuacaacgccgagcugcuggugcugcuggagaacgagagaacccuggacuuccacgacagcaacgugaagaaccuguacgagaaggugagaagccagcugaagaacaacgccaaggagaucggcaacggcugcuucgaguucuaccacaagugcgacgacgccugcauggagagcgugaagaacggcaccuacgacuaccccaaguacagcgaggagagcagacugaacagagaggagaucgacggcaucaagcuggacagcaccagaaucuaccagauccuggccaucuacagcaccguggccagcagcagcgugcugcuggugagccugggcgccaucagcuucuggaugugcagcaacggcagccugcagugcagaaucugcaucuga

SEQ ID NO: 153011 - RNA, 1701 nt, Artificial Sequence
  derived and/or modified sequence opt4 from hemagglutinin__InfluenzaA__ABB96319
augaagaccaucaucgcccugagcuacaucuucugccagguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacaacccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucuucaacgagggcuucaacuggaccggcgugacccagaacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggccccagacccugggugagaggccugagcagcagaaucagcaucuacuggaccaucgugaagcccggcgacgugcugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153012 - RNA, 1701 nt, Artificial Sequence
  derived and/or modified sequence opt4 from hemagglutinin__InfluenzaA__ABB96330
augaagaccaucaucgcccugagcuacaucuucugccagguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacaacccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucuucaacgagggcuucaacuggaccggcgugacccagaacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacgugcugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacagacccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccagaaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153013 - RNA, 1701 nt, Artificial Sequence
  derived and/or modified sequence opt4 from hemagglutinin__InfluenzaA__ABB96341
augaagaccaucaucgcccugagcuacaucuucugccagguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacaacccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucuucaacgagggcuucaacuggaccggcgugacccagaacggcggcagcuacgccugcaagaagggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacgugcugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153014 - RNA, 1701 nt, Artificial Sequence
  derived and/or modified sequence opt4 from hemagglutinin__InfluenzaA__ABB96395
augaagaccaucaucgcccugagcuacaucuucugccagguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugauggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagagaaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153015 - RNA, 1698 nt, Artificial Sequence
  derived and/or modified sequence opt4 from hemagglutinin__InfluenzaA__ABB96487
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaagaagagcagcuggcccaaccacaccgugaccggcgugagcgccagcugcagccacgacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153016 - RNA, 1701 nt, Artificial Sequence
  derived and/or modified sequence opt4 from hemagglutinin__InfluenzaA__ABB96520
augaagaccaucaucgcccugagcuacaucuucugccuggcccugggccaggaccugcccggcaacggcaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaagacccugaagcuggccaccggcaugagaaacauccccgagaagaagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 153017 - RNA, 1701 nt, Artificial Sequence
  derived and/or modified sequence opt4 from hemagglutinin__InfluenzaA__ABB96531
augaagaccaucaucgcccugagcuacauccugugccuggugagcgcccagaagauccccggcaacgacagcagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153018 - RNA, 1701 nt, Artificial Sequence
  derived and/or modified sequence opt4 from hemagglutinin__InfluenzaA__ABC02234
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagaucagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccuguucugcguggugcugcugggcuucaucaugugggccugccagaagggcaacaucagaugcaacaucugcaucuga

SEQ ID NO: 153019 - RNA, 1701 nt, Artificial Sequence
  derived and/or modified sequence opt4 from hemagglutinin__InfluenzaA__ABC02255
augaagaccaucaucgcccugagcuacaucuucugccuggugcuggcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccuggugaucaacagcaacggcaaccugaucgcccccagaggccacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153020 - RNA, 1701 nt, Artificial Sequence
  derived and/or modified sequence opt4 from hemagglutinin__InfluenzaA__ABC02266
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagagccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153021 - RNA, 1701 nt, Artificial Sequence
  derived and/or modified sequence opt4 from hemagglutinin__InfluenzaA__ABC02288
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggccacaaggacuggauccuguggaucagcuucgccaucagcugcuuccugcugugcguggugcugcugggcuucaucaugugggccugccagaagggcaacaucagaugcaacaucugcaucuga

SEQ ID NO: 153022 - RNA, 1701 nt, Artificial Sequence; identical to SEQ ID NO: 152990
  derived and/or modified sequence opt4 from hemagglutinin__InfluenzaA__ABC02299

SEQ ID NO: 153023 - RNA, 1701 nt, Artificial Sequence; identical to SEQ ID NO: 153014
  derived and/or modified sequence opt4 from hemagglutinin__InfluenzaA__ABC02310

SEQ ID NO: 153024 - RNA, 1701 nt, Artificial Sequence; identical to SEQ ID NO: 153019
  derived and/or modified sequence opt4 from hemagglutinin__InfluenzaA__ABC02321

SEQ ID NO: 153025 - RNA, 1701 nt, Artificial Sequence; identical to SEQ ID NO: 152825
  derived and/or modified sequence opt4 from hemagglutinin__InfluenzaA__ABC02332

SEQ ID NO: 153026 - RNA, 1701 nt, Artificial Sequence
  derived and/or modified sequence opt4 from hemagglutinin__InfluenzaA__ABC39805
augaagaccaucaucgcccugagcuacauccugugccugguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcgccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcaggacuacgccagccugagaagccugguggccagcagcggcacccuggaguucaucaacgagggcuucaacuggaccggcgugacccagagcggcggcagcuacgccugcaagagaggcagcggcaacagcuucuucagcagacugaacuggcuguacaagagcgagagcaaguaccccgcccugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcagcggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153027 - RNA, 1698 nt, Artificial Sequence
  derived and/or modified sequence opt4 from hemagglutinin__InfluenzaA__ABC40522
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153028 - RNA, 1698 nt, Artificial Sequence; identical to SEQ ID NO: 152816
  derived and/or modified sequence opt4 from hemagglutinin__InfluenzaA__ABC40533

SEQ ID NO: 153029 - RNA, 1701 nt, Artificial Sequence
  derived and/or modified sequence opt4 from hemagglutinin__InfluenzaA__ABC40555
augaagaccaucaucgcccugagcuacaucuucugccugguguucgcccagaaccugcccagaaacgacaagagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153030 - RNA, 1701 nt, Artificial Sequence
  derived and/or modified sequence opt4 from hemagglutinin__InfluenzaA__ABC40608
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccagaagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagagcgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153031 - RNA, 1701 nt, Artificial Sequence
  derived and/or modified sequence opt4 from hemagglutinin__InfluenzaA__ABC40619
augaagaccaucaucgcccugagcuacaucuucugccuggugcugggccaggacuucagcggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcaacgccugcaagagaggccccgacagcggcuucuucagcagacugaacuggcuguacaagagcggcagcaccuaccccgugcugaacgugagcaugcccaacaacgacaacuucgacaagcuguacaucuggggcgugcaccaccccagcaccgaccaggagcagaccaaccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153032 - RNA, 1698 nt, Artificial Sequence
  derived and/or modified sequence opt4 from hemagglutinin__InfluenzaA__ABC40631
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153033 - RNA, 1701 nt, Artificial Sequence
  derived and/or modified sequence opt4 from hemagglutinin__InfluenzaA__ABC41692
augaagaccaucaucgcccugagcuacauccugugccugguguucgcccagaagccccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153034 - RNA, 1698 nt, Artificial Sequence; identical to SEQ ID NO: 152819
  derived and/or modified sequence opt4 from hemagglutinin__InfluenzaA__ABC41714

SEQ ID NO: 153035 - RNA, 1701 nt, Artificial Sequence
  derived and/or modified sequence opt4 from hemagglutinin__InfluenzaA__ABC41725
augaagaccaccaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153036 - RNA, 1701 nt, Artificial Sequence
  derived and/or modified sequence opt4 from hemagglutinin__InfluenzaA__ABC41736
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153037 - RNA, 1701 nt, Artificial Sequence; identical to SEQ ID NO: 153036
  derived and/or modified sequence opt4 from hemagglutinin__InfluenzaA__ABC41952

SEQ ID NO: 153038 - RNA, 1701 nt, Artificial Sequence; identical to SEQ ID NO: 153036
  derived and/or modified sequence opt4 from hemagglutinin__InfluenzaA__ABC41953

SEQ ID NO: 153039 - RNA, 1701 nt, Artificial Sequence; identical to SEQ ID NO: 153036
  derived and/or modified sequence opt4 from hemagglutinin__InfluenzaA__ABC41964

SEQ ID NO: 153040 - RNA, 1701 nt, Artificial Sequence; identical to SEQ ID NO: 153036
  derived and/or modified sequence opt4 from hemagglutinin__InfluenzaA__ABC42014

SEQ ID NO: 153041 - RNA, 1701 nt, Artificial Sequence; identical to SEQ ID NO: 153036
  derived and/or modified sequence opt4 from hemagglutinin__InfluenzaA__ABC42114

SEQ ID NO: 153042 - RNA, 1701 nt, Artificial Sequence; identical to SEQ ID NO: 153036
  derived and/or modified sequence opt4 from hemagglutinin__InfluenzaA__ABC42125

SEQ ID NO: 153043 - RNA, 1701 nt, Artificial Sequence; identical to SEQ ID NO: 153036
  derived and/or modified sequence opt4 from hemagglutinin__InfluenzaA__ABC42136

SEQ ID NO: 153044 - RNA, 1701 nt, Artificial Sequence
  derived and/or modified sequence opt4 from hemagglutinin__InfluenzaA__ABC42147
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgugcccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153045 - RNA, 1701 nt, Artificial Sequence; identical to SEQ ID NO: 153036
  derived and/or modified sequence opt4 from hemagglutinin__InfluenzaA__ABC42158

SEQ ID NO: 153046 - RNA, 1701 nt, Artificial Sequence; identical to SEQ ID NO: 153036
  derived and/or modified sequence opt4 from hemagglutinin__InfluenzaA__ABC42169

SEQ ID NO: 153047 - RNA, 1701 nt, Artificial Sequence; identical to SEQ ID NO: 153036
  derived and/or modified sequence opt4 from hemagglutinin__InfluenzaA__ABC42180

SEQ ID NO: 153048 - RNA, 1701 nt, Artificial Sequence; identical to SEQ ID NO: 153036
  derived and/or modified sequence opt4 from hemagglutinin__InfluenzaA__ABC42192

SEQ ID NO: 153049 - RNA, 1701 nt, Artificial Sequence; identical to SEQ ID NO: 153036
  derived and/or modified sequence opt4 from hemagglutinin__InfluenzaA__ABC42307

SEQ ID NO: 153050 - RNA, 1701 nt, Artificial Sequence
  derived and/or modified sequence opt4 from hemagglutinin__InfluenzaA__ABC42318
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153051 - RNA, 1701 nt, Artificial Sequence; identical to SEQ ID NO: 153036
  derived and/or modified sequence opt4 from hemagglutinin__InfluenzaA__ABC42346

SEQ ID NO: 153052 - RNA, 1701 nt, Artificial Sequence; identical to SEQ ID NO: 153036
  derived and/or modified sequence opt4 from hemagglutinin__InfluenzaA__ABC42461

SEQ ID NO: 153053 - RNA, 1701 nt, Artificial Sequence; identical to SEQ ID NO: 153036
  derived and/or modified sequence opt4 from hemagglutinin__InfluenzaA__ABC42494

SEQ ID NO: 153054 - RNA, 1701 nt, Artificial Sequence; identical to SEQ ID NO: 153036
  derived and/or modified sequence opt4 from hemagglutinin__InfluenzaA__ABC42505

SEQ ID NO: 153055 - RNA, 1701 nt, Artificial Sequence
  derived and/or modified sequence opt4 from hemagglutinin__InfluenzaA__ABC42516
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacaagcugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153056 - RNA, 1701 nt, Artificial Sequence; identical to SEQ ID NO: 153036
  derived and/or modified sequence opt4 from hemagglutinin__InfluenzaA__ABC42527

SEQ ID NO: 153057 - RNA, 1701 nt, Artificial Sequence; identical to SEQ ID NO: 153036
  derived and/or modified sequence opt4 from hemagglutinin__InfluenzaA__ABC42574

SEQ ID NO: 153058 - RNA, 1701 nt, Artificial Sequence; identical to SEQ ID NO: 153036
  derived and/or modified sequence opt4 from hemagglutinin__InfluenzaA__ABC42585

SEQ ID NO: 153059 - RNA, 1701 nt, Artificial Sequence; identical to SEQ ID NO: 152763
  derived and/or modified sequence opt4 from hemagglutinin__InfluenzaA__ABC42596

SEQ ID NO: 153060 - RNA, 1701 nt, Artificial Sequence; identical to SEQ ID NO: 152802
  derived and/or modified sequence opt4 from hemagglutinin__InfluenzaA__ABC42607

SEQ ID NO: 153061 - RNA, 1701 nt, Artificial Sequence; identical to SEQ ID NO: 152802
  derived and/or modified sequence opt4 from hemagglutinin__InfluenzaA__ABC42618

SEQ ID NO: 153062 - RNA, 1701 nt, Artificial Sequence
  derived and/or modified sequence opt4 from hemagglutinin__InfluenzaA__ABC42629
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153063 - RNA, 1701 nt, Artificial Sequence
  derived and/or modified sequence opt4 from hemagglutinin__InfluenzaA__ABC42640
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153064 - RNA, 1701 nt, Artificial Sequence; identical to SEQ ID NO: 152763
  derived and/or modified sequence opt4 from hemagglutinin__InfluenzaA__ABC42651

SEQ ID NO: 153065 - RNA, 1701 nt, Artificial Sequence
  derived and/or modified sequence opt4 from hemagglutinin__InfluenzaA__ABC42662
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgaguuccugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153066 - RNA, 1701 nt, Artificial Sequence
  derived and/or modified sequence opt4 from hemagglutinin__InfluenzaA__ABC42673
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153067 - RNA, 1701 nt, Artificial Sequence; identical to SEQ ID NO: 152763
  derived and/or modified sequence opt4 from hemagglutinin__InfluenzaA__ABC42684

SEQ ID NO: 153068 - RNA, 1701 nt, Artificial Sequence; identical to SEQ ID NO: 152763
  derived and/or modified sequence opt4 from hemagglutinin__InfluenzaA__ABC42695

SEQ ID NO: 153069 - RNA, 1701 nt, Artificial Sequence
  derived and/or modified sequence opt4 from hemagglutinin__InfluenzaA__ABC42706
augaagaccaucaucgcccugagcuacauccugugccugguguucgcccagaagcugcccggcaacgacaacagcaccgccacccugugccugggccaccacgccgugcccaacggcaccaccgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153070 - RNA, 1701 nt, Artificial Sequence; identical to SEQ ID NO: 152763
  derived and/or modified sequence opt4 from hemagglutinin__InfluenzaA__ABC42717

SEQ ID NO: 153071 - RNA, 1701 nt, Artificial Sequence
  derived and/or modified sequence opt4 from hemagglutinin__InfluenzaA__ABC42728
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcggcaucugcgacagcccccaccagauccuggacggcgagaacugcacccugauggacgcccugcugggcgacccccagugcgacggcuuccagaacaagaagugggaccuguucguggagagaagcagagccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153072 - RNA, 1701 nt, Artificial Sequence; identical to SEQ ID NO: 152763
  derived and/or modified sequence opt4 from hemagglutinin__InfluenzaA__ABC42739

SEQ ID NO: 153073 - RNA, 1698 nt, Artificial Sequence
  derived and/or modified sequence opt4 from hemagglutinin__InfluenzaA__ABC42750
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagaagcccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacaagaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaaaguucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaacagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuucaucgacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153074 - RNA, 1701 nt, Artificial Sequence; identical to SEQ ID NO: 152763
  derived and/or modified sequence opt4 from hemagglutinin__InfluenzaA__ABC42761

SEQ ID NO: 153075 - RNA, 1701 nt, Artificial Sequence
  derived and/or modified sequence opt4 from hemagglutinin__InfluenzaA__ABC42772
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153076 - RNA, 1701 nt, Artificial Sequence; identical to SEQ ID NO: 152763
  derived and/or modified sequence opt4 from hemagglutinin__InfluenzaA__ABC42783

SEQ ID NO: 153077 - RNA, 1701 nt, Artificial Sequence; identical to SEQ ID NO: 152763
  derived and/or modified sequence opt4 from hemagglutinin__InfluenzaA__ABC42794

SEQ ID NO: 153078 - RNA, 1701 nt, Artificial Sequence; identical to SEQ ID NO: 152763
  derived and/or modified sequence opt4 from hemagglutinin__InfluenzaA__ABC42805

SEQ ID NO: 153079 - RNA, 1701 nt, Artificial Sequence; identical to SEQ ID NO: 152802
  derived and/or modified sequence opt4 from hemagglutinin__InfluenzaA__ABC42816

SEQ ID NO: 153080 - RNA, 1701 nt, Artificial Sequence
  derived and/or modified sequence opt4 from hemagglutinin__InfluenzaA__ABC42827
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaugagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153081 - RNA, 1701 nt, Artificial Sequence; identical to SEQ ID NO: 152763
  derived and/or modified sequence opt4 from hemagglutinin__InfluenzaA__ABC42849

SEQ ID NO: 153082 - RNA, 1701 nt, Artificial Sequence
  derived and/or modified sequence opt4 from hemagglutinin__InfluenzaA__ABC42882
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153083 - RNA, 1701 nt, Artificial Sequence; identical to SEQ ID NO: 153082
  derived and/or modified sequence opt4 from hemagglutinin__InfluenzaA__ABC42893

SEQ ID NO: 153084 - RNA, 1701 nt, Artificial Sequence; identical to SEQ ID NO: 153036
  derived and/or modified sequence opt4 from hemagglutinin__InfluenzaA__ABC42929

SEQ ID NO: 153085 - RNA, 1701 nt, Artificial Sequence; identical to SEQ ID NO: 153036
  derived and/or modified sequence opt4 from hemagglutinin__InfluenzaA__ABC42940

SEQ ID NO: 153086 - RNA, 1701 nt, Artificial Sequence; identical to SEQ ID NO: 153036
  derived and/or modified sequence opt4 from hemagglutinin__InfluenzaA__ABC42951

SEQ ID NO: 153087 - RNA, 1701 nt, Artificial Sequence; identical to SEQ ID NO: 153036
  derived and/or modified sequence opt4 from hemagglutinin__InfluenzaA__ABC42962

SEQ ID NO: 153088 - RNA, 1701 nt, Artificial Sequence; identical to SEQ ID NO: 153036
  derived and/or modified sequence opt4 from hemagglutinin__InfluenzaA__ABC42973

SEQ ID NO: 153089 - RNA, 1701 nt, Artificial Sequence; identical to SEQ ID NO: 153036
  derived and/or modified sequence opt4 from hemagglutinin__InfluenzaA__ABC42995

SEQ ID NO: 153090 - RNA, 1701 nt, Artificial Sequence; identical to SEQ ID NO: 153036
  derived and/or modified sequence opt4 from hemagglutinin__InfluenzaA__ABC43006

SEQ ID NO: 153091 - RNA, 1701 nt, Artificial Sequence; identical to SEQ ID NO: 153036
  derived and/or modified sequence opt4 from hemagglutinin__InfluenzaA__ABC43028

SEQ ID NO: 153092 - RNA, 1701 nt, Artificial Sequence; identical to SEQ ID NO: 153036
  derived and/or modified sequence opt4 from hemagglutinin__InfluenzaA__ABC43039

SEQ ID NO: 153093 - RNA, 1701 nt, Artificial Sequence; identical to SEQ ID NO: 153036
  derived and/or modified sequence opt4 from hemagglutinin__InfluenzaA__ABC43050

SEQ ID NO: 153094 - RNA, 1701 nt, Artificial Sequence; identical to SEQ ID NO: 153036
  derived and/or modified sequence opt4 from hemagglutinin__InfluenzaA__ABC43061

SEQ ID NO: 153095 - RNA, 1701 nt, Artificial Sequence
  derived and/or modified sequence opt4 from hemagglutinin__InfluenzaA__ABC43072
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucaccaucagcugcuuccugcugugcguggcccugcugggcuucaucaugugggccugccagaagggcaacaucagaugcaacaucugcaucuga

SEQ ID NO: 153096 - RNA, 1701 nt, Artificial Sequence; identical to SEQ ID NO: 153036
  derived and/or modified sequence opt4 from hemagglutinin__InfluenzaA__ABC43083

SEQ ID NO: 153097 - RNA, 1701 nt, Artificial Sequence; identical to SEQ ID NO: 153036
  derived and/or modified sequence opt4 from hemagglutinin__InfluenzaA__ABC43094

SEQ ID NO: 153098 - RNA, 1701 nt, Artificial Sequence; identical to SEQ ID NO: 153036
  derived and/or modified sequence opt4 from hemagglutinin__InfluenzaA__ABC43116

SEQ ID NO: 153099 - RNA, 1701 nt, Artificial Sequence; identical to SEQ ID NO: 152763
  derived and/or modified sequence opt4 from hemagglutinin__InfluenzaA__ABC43127

SEQ ID NO: 153100 - RNA, 1701 nt, Artificial Sequence; identical to SEQ ID NO: 152802
  derived and/or modified sequence opt4 from hemagglutinin__InfluenzaA__ABC43138

SEQ ID NO: 153101 - RNA, 1701 nt, Artificial Sequence; identical to SEQ ID NO: 152763
  derived and/or modified sequence opt4 from hemagglutinin__InfluenzaA__ABC43149

SEQ ID NO: 153102 - RNA, 1701 nt, Artificial Sequence; identical to SEQ ID NO: 152763
  derived and/or modified sequence opt4 from hemagglutinin__InfluenzaA__ABC43160

SEQ ID NO: 153103 - RNA, 1701 nt, Artificial Sequence; identical to SEQ ID NO: 152763
  derived and/or modified sequence opt4 from hemagglutinin__InfluenzaA__ABC43171

SEQ ID NO: 153104 - RNA, 1701 nt, Artificial Sequence; identical to SEQ ID NO: 152763
  derived and/or modified sequence opt4 from hemagglutinin__InfluenzaA__ABC43182

SEQ ID NO: 153105 - RNA, 1701 nt, Artificial Sequence
  derived and/or modified sequence opt4 from hemagglutinin__InfluenzaA__ABC43475
augaagaccaucaucgcccugagcuacauccugugccugguguucgcccagaagcugcccggcaacgacaacagcaccgccacccugugccugggccaccacgccgugcccaacggcaccaccgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153106 - RNA, 1701 nt, Artificial Sequence; identical to SEQ ID NO: 152763
  derived and/or modified sequence opt4 from hemagglutinin__InfluenzaA__ABC43486

SEQ ID NO: 153107 - RNA, 1701 nt, Artificial Sequence; identical to SEQ ID NO: 152763
  derived and/or modified sequence opt4 from hemagglutinin__InfluenzaA__ABC43497

SEQ ID NO: 153108 - RNA, 1701 nt, Artificial Sequence; identical to SEQ ID NO: 152802
  derived and/or modified sequence opt4 from hemagglutinin__InfluenzaA__ABC43508

SEQ ID NO: 153109 - RNA, 1701 nt, Artificial Sequence; identical to SEQ ID NO: 152802
  derived and/or modified sequence opt4 from hemagglutinin__InfluenzaA__ABC43519

SEQ ID NO: 153110 - RNA, 1701 nt, Artificial Sequence; identical to SEQ ID NO: 152802
  derived and/or modified sequence opt4 from hemagglutinin__InfluenzaA__ABC43530

SEQ ID NO: 153111 - RNA, 1701 nt, Artificial Sequence
  derived and/or modified sequence opt4 from hemagglutinin__InfluenzaA__ABC43552
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggcccccggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153112 - RNA, 1701 nt, Artificial Sequence
  derived and/or modified sequence opt4 from hemagglutinin__InfluenzaA__ABC46554
augaagaccaucaucgcccugagcuacaucuucugccagguguucgcccagaaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccaggacggcggcagcuacgccugcaagagaggccccgacaacagcuucuucagcagacugaacuggcuguacaagagcgagagcaccuaccccgugcugaacgugaccaugcccaacaacgacaacuucgacaagcuguacaucuggggcgugcaccaccccagcaccgacaaggagcagaccaaccuguacgugcaggccagcggcagagugaccgugagcaccaagagaagccagcagaccaucauccccaacgugggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153113 - RNA, 1701 nt, Artificial Sequence
  derived and/or modified sequence opt4 from hemagglutinin__InfluenzaA__ABC46576
augaagaccaucaucgcccugagcuacaucuucugccugguguucgcccagaaccugcccggcaacgacaagagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugguggacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagagcuucaacuggaccggcgugacccagagcggcggcagcuacgccugcaagagaggcagcgacaacagcuucuucagcagacugaacuggcuguacgagagcgagagcaaguaccccgugcugaacgugaccaugcccaacaacggcaacuucgacaagcuguacaucuggggcgugcaccaccccagcaccgacaaggagcagaccaaccuguacgugagagccagcggcagagugaccgugagcaccaagagaagccagcagaccaucauccccaacaucggcagcagacccugggugagaggccugagcagcagaaucagcaucuacuggaccaucgugaagcccggcgacauccugcugaucaacagcaacggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153114 - RNA, 1701 nt, Artificial Sequence; identical to SEQ ID NO: 152972
  derived and/or modified sequence opt4 from hemagglutinin__InfluenzaA__ABC50167

SEQ ID NO: 153115 - RNA, 1701 nt, Artificial Sequence; identical to SEQ ID NO: 152972
  derived and/or modified sequence opt4 from hemagglutinin__InfluenzaA__ABC50178

SEQ ID NO: 153116 - RNA, 1701 nt, Artificial Sequence; identical to SEQ ID NO: 152972
  derived and/or modified sequence opt4 from hemagglutinin__InfluenzaA__ABC50189

SEQ ID NO: 153117 - RNA, 1701 nt, Artificial Sequence; identical to SEQ ID NO: 153082
  derived and/or modified sequence opt4 from hemagglutinin__InfluenzaA__ABC50200

SEQ ID NO: 153118 - RNA, 1701 nt, Artificial Sequence; identical to SEQ ID NO: 153082
  derived and/or modified sequence opt4 from hemagglutinin__InfluenzaA__ABC50211

SEQ ID NO: 153119 - RNA, 1701 nt, Artificial Sequence; identical to SEQ ID NO: 153082
  derived and/or modified sequence opt4 from hemagglutinin__InfluenzaA__ABC50222

SEQ ID NO: 153120 - RNA, 1701 nt, Artificial Sequence; identical to SEQ ID NO: 153082
  derived and/or modified sequence opt4 from hemagglutinin__InfluenzaA__ABC50233

SEQ ID NO: 153121 - RNA, 1701 nt, Artificial Sequence; identical to SEQ ID NO: 153082
  derived and/or modified sequence opt4 from hemagglutinin__InfluenzaA__ABC50244

SEQ ID NO: 153122 - RNA, 1701 nt, Artificial Sequence; identical to SEQ ID NO: 153082
  derived and/or modified sequence opt4 from hemagglutinin__InfluenzaA__ABC50266

SEQ ID NO: 153123 - RNA, 1701 nt, Artificial Sequence; identical to SEQ ID NO: 153082
  derived and/or modified sequence opt4 from hemagglutinin__InfluenzaA__ABC50277

SEQ ID NO: 153124 - RNA, 1701 nt, Artificial Sequence
  derived and/or modified sequence opt4 from hemagglutinin__InfluenzaA__ABC50299
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaccagcugcuuccugcugugcaucgugcugcugggcuucaucaugugggccugccagaagggcaacaucagaugcaacaucugcaucuga

SEQ ID NO: 153125 - RNA, 1701 nt, Artificial Sequence; identical to SEQ ID NO: 153082
  derived and/or modified sequence opt4 from hemagglutinin__InfluenzaA__ABC50310

SEQ ID NO: 153126 - RNA, 1701 nt, Artificial Sequence
  derived and/or modified sequence opt4 from hemagglutinin__InfluenzaA__ABC50321
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccggcaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153127 - RNA, 1701 nt, Artificial Sequence
  derived and/or modified sequence opt4 from hemagglutinin__InfluenzaA__ABC50332
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153128 - RNA, 1701 nt, Artificial Sequence; identical to SEQ ID NO: 153082
  derived and/or modified sequence opt4 from hemagglutinin__InfluenzaA__ABC50343

SEQ ID NO: 153129 - RNA, 1701 nt, Artificial Sequence
  derived and/or modified sequence opt4 from hemagglutinin__InfluenzaA__ABC50354
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcagcugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153130 - RNA, 1701 nt, Artificial Sequence
  derived and/or modified sequence opt4 from hemagglutinin__InfluenzaA__ABC50376
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaccggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153131 - RNA, 1701 nt, Artificial Sequence
  derived and/or modified sequence opt4 from hemagglutinin__InfluenzaA__ABC50387
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacguguggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153132 - RNA, 1701 nt, Artificial Sequence
  derived and/or modified sequence opt4 from hemagglutinin__InfluenzaA__ABC50409
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153133 - RNA, 1701 nt, Artificial Sequence; identical to SEQ ID NO: 153132
  derived and/or modified sequence opt4 from hemagglutinin__InfluenzaA__ABC50420

SEQ ID NO: 153134 - RNA, 1701 nt, Artificial Sequence
  derived and/or modified sequence opt4 from hemagglutinin__InfluenzaA__ABC54668
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagccugcccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153135 - RNA, 1701 nt, Artificial Sequence
  derived and/or modified sequence opt4 from hemagglutinin__InfluenzaA__ABC54679
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagccccaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacgugggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153136 - RNA, 1701 nt, Artificial Sequence; identical to SEQ ID NO: 153036
  derived and/or modified sequence opt4 from hemagglutinin__InfluenzaA__ABC67319

SEQ ID NO: 153137 - RNA, 1701 nt, Artificial Sequence
  derived and/or modified sequence opt4 from hemagglutinin__InfluenzaA__ABC67454
augaagaccaucaucgcccugagcuacauccugugccugguguucgcccaggagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153138 - RNA, 1701 nt, Artificial Sequence; identical to SEQ ID NO: 153082
  derived and/or modified sequence opt4 from hemagglutinin__InfluenzaA__ABC67471

SEQ ID NO: 153139 - RNA, 1701 nt, Artificial Sequence
  derived and/or modified sequence opt4 from hemagglutinin__InfluenzaA__ABC67554
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgugaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153140 - RNA, 1701 nt, Artificial Sequence
  derived and/or modified sequence opt4 from hemagglutinin__InfluenzaA__ABC67565
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacaucggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153141 - RNA, 1701 nt, Artificial Sequence
  derived and/or modified sequence opt4 from hemagglutinin__InfluenzaA__ABC67576
augaagaccaucaucgcccugagcuacauccugugccugguguucgcccagaagcugcccggcaacgacaacagcauggccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaucaagagcuucuucagcagacugaacuggcugcaccagcugaaguacaaguaccccgcccugaacgugaccaugcccaacaacgacgaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153142 - RNA, 1701 nt, Artificial Sequence
  derived and/or modified sequence opt4 from hemagglutinin__InfluenzaA__ABC67587
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153143 - RNA, 1701 nt, Artificial Sequence; identical to SEQ ID NO: 152763
  derived and/or modified sequence opt4 from hemagglutinin__InfluenzaA__ABC67598

SEQ ID NO: 153144 - RNA, 1701 nt, Artificial Sequence; identical to SEQ ID NO: 153082
  derived and/or modified sequence opt4 from hemagglutinin__InfluenzaA__ABC67609

SEQ ID NO: 153145 - RNA, 1701 nt, Artificial Sequence; identical to SEQ ID NO: 153082
  derived and/or modified sequence opt4 from hemagglutinin__InfluenzaA__ABC67620

SEQ ID NO: 153146 - RNA, 1701 nt, Artificial Sequence; identical to SEQ ID NO: 153082
  derived and/or modified sequence opt4 from hemagglutinin__InfluenzaA__ABC67631

SEQ ID NO: 153147 - RNA, 1701 nt, Artificial Sequence; identical to SEQ ID NO: 153082
  derived and/or modified sequence opt4 from hemagglutinin__InfluenzaA__ABC67642

SEQ ID NO: 153148 - RNA, 1701 nt, Artificial Sequence
  derived and/or modified sequence opt4 from hemagglutinin__InfluenzaA__ABC67653
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcguggugcugcugggcuucaucaugugggccugccagaagggcaacaucagaugcaacaucugcaucuga

SEQ ID NO: 153149 - RNA, 1701 nt, Artificial Sequence
  derived and/or modified sequence opt4 from hemagglutinin__InfluenzaA__ABC67697
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153150 - RNA, 1701 nt, Artificial Sequence
  derived and/or modified sequence opt4 from hemagglutinin__InfluenzaA__ABC67708
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153151 - RNA, 1701 nt, Artificial Sequence; identical to SEQ ID NO: 153150
  derived and/or modified sequence opt4 from hemagglutinin__InfluenzaA__ABC67719

SEQ ID NO: 153152 - RNA, 1701 nt, Artificial Sequence; identical to SEQ ID NO: 153150
  derived and/or modified sequence opt4 from hemagglutinin__InfluenzaA__ABC67733

SEQ ID NO: 153153 - RNA, 1701 nt, Artificial Sequence
  derived and/or modified sequence opt4 from hemagglutinin__InfluenzaA__ABC67806
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153154 - RNA, 1701 nt, Artificial Sequence; identical to SEQ ID NO: 153036
  derived and/or modified sequence opt4 from hemagglutinin__InfluenzaA__ABC67817

SEQ ID NO: 153155 - RNA, 1701 nt, Artificial Sequence; identical to SEQ ID NO: 153150
  derived and/or modified sequence opt4 from hemagglutinin__InfluenzaA__ABC67828

SEQ ID NO: 153156 - RNA, 1701 nt, Artificial Sequence; identical to SEQ ID NO: 153014
  derived and/or modified sequence opt4 from hemagglutinin__InfluenzaA__ABC67839

SEQ ID NO: 153157 - RNA, 1701 nt, Artificial Sequence
  derived and/or modified sequence opt4 from hemagglutinin__InfluenzaA__ABC67850
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggccagaggcgugagcagcagaaucagcauccacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153158 - RNA, 1701 nt, Artificial Sequence; identical to SEQ ID NO: 153014
  derived and/or modified sequence opt4 from hemagglutinin__InfluenzaA__ABC67861

SEQ ID NO: 153159 - RNA, 1701 nt, Artificial Sequence; identical to SEQ ID NO: 153082
  derived and/or modified sequence opt4 from hemagglutinin__InfluenzaA__ABC67883

SEQ ID NO: 153160 - RNA, 1701 nt, Artificial Sequence
  derived and/or modified sequence opt4 from hemagglutinin__InfluenzaA__ABC67894
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcaagcugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153161 - RNA, 1701 nt, Artificial Sequence; identical to SEQ ID NO: 153082
  derived and/or modified sequence opt4 from hemagglutinin__InfluenzaA__ABC67967

SEQ ID NO: 153162 - RNA, 1701 nt, Artificial Sequence; identical to SEQ ID NO: 153082
  derived and/or modified sequence opt4 from hemagglutinin__InfluenzaA__ABC67978

SEQ ID NO: 153163 - RNA, 1701 nt, Artificial Sequence
  derived and/or modified sequence opt4 from hemagglutinin__InfluenzaA__ABC67989
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaaggugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgugugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153164 - RNA, 1701 nt, Artificial Sequence; identical to SEQ ID NO: 153137
  derived and/or modified sequence opt4 from hemagglutinin__InfluenzaA__ABC68000

SEQ ID NO: 153165 - RNA, 1701 nt, Artificial Sequence
  derived and/or modified sequence opt4 from hemagglutinin__InfluenzaA__ABC68049
augaagaccaucaucgcccugagcuacauccugugccugguguucgcccagaagcugcccggcaacgacaacagcaccgccacccugugccugggccaccacgccgugcccaacggcacccuggugaagaccaucaccgacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacguguggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153166 - RNA, 1701 nt, Artificial Sequence; identical to SEQ ID NO: 153082
  derived and/or modified sequence opt4 from hemagglutinin__InfluenzaA__ABC68060

SEQ ID NO: 153167 - RNA, 1701 nt, Artificial Sequence
  derived and/or modified sequence opt4 from hemagglutinin__InfluenzaA__ABC68071
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacaacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153168 - RNA, 1701 nt, Artificial Sequence; identical to SEQ ID NO: 153150
  derived and/or modified sequence opt4 from hemagglutinin__InfluenzaA__ABC68082

SEQ ID NO: 153169 - RNA, 1701 nt, Artificial Sequence
  derived and/or modified sequence opt4 from hemagglutinin__InfluenzaA__ABC68093
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcaucgugcugcugggcuucaucaugugggccugccagaagggcaacaucagaugcaacaucugcaucuga

SEQ ID NO: 153170 - RNA, 1701 nt, Artificial Sequence
  derived and/or modified sequence opt4 from hemagglutinin__InfluenzaA__ABC68222
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153171 - RNA, 1701 nt, Artificial Sequence; identical to SEQ ID NO: 152962
  derived and/or modified sequence opt4 from hemagglutinin__InfluenzaA__ABC68233

SEQ ID NO: 153172 - RNA, 1707 nt, Artificial Sequence
  derived and/or modified sequence opt4 from hemagglutinin__InfluenzaA__ABC72655
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaagcccaaccccgccaacgaccugugcuaccccggcgacuucaacgacuacgaggagcugaagcaccugcugagcagaaucaaccacuucgagaagauccagaucauccccaagagcagcuggagcagccacgaggccagcgugggcgugagcagcgugugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 153173 - RNA, 1701 nt, Artificial Sequence; identical to SEQ ID NO: 152763
  derived and/or modified sequence opt4 from hemagglutinin__InfluenzaA__ABC84400

SEQ ID NO: 153174 - RNA, 1701 nt, Artificial Sequence; identical to SEQ ID NO: 152972
  derived and/or modified sequence opt4 from hemagglutinin__InfluenzaA__ABC84411

SEQ ID NO: 153175 - RNA, 1701 nt, Artificial Sequence
  derived and/or modified sequence opt4 from hemagglutinin__InfluenzaA__ABC84433
augaagaccaucaucgcccugagcuacauccugugccugguguucgcccagaagcugcccggcaacgacaacagaaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153176 - RNA, 1701 nt, Artificial Sequence; identical to SEQ ID NO: 153082
  derived and/or modified sequence opt4 from hemagglutinin__InfluenzaA__ABC84444

SEQ ID NO: 153177 - RNA, 1701 nt, Artificial Sequence; identical to SEQ ID NO: 153153
  derived and/or modified sequence opt4 from hemagglutinin__InfluenzaA__ABC84498

SEQ ID NO: 153178 - RNA, 1701 nt, Artificial Sequence; identical to SEQ ID NO: 153153
  derived and/or modified sequence opt4 from hemagglutinin__InfluenzaA__ABC84509

SEQ ID NO: 153179 - RNA, 1701 nt, Artificial Sequence
  derived and/or modified sequence opt4 from hemagglutinin__InfluenzaA__ABC84520
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153180 - RNA, 1701 nt, Artificial Sequence
  derived and/or modified sequence opt4 from hemagglutinin__InfluenzaA__ABC84531
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgcccugaacgugaccaugcccaacaacggcagauucgacaagcuguacaucuggggcgugcaccaccccagcaccgacaaggagcagaccaaccuguacgugagagccgccggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153181 - RNA, 1701 nt, Artificial Sequence; identical to SEQ ID NO: 153170
  derived and/or modified sequence opt4 from hemagglutinin__InfluenzaA__ABC84560

SEQ ID NO: 153182 - RNA, 1701 nt, Artificial Sequence
  derived and/or modified sequence opt4 from hemagglutinin__InfluenzaA__ABC84571
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagaucaucgacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153183 - RNA, 1701 nt, Artificial Sequence; identical to SEQ ID NO: 153170
  derived and/or modified sequence opt4 from hemagglutinin__InfluenzaA__ABC85754

SEQ ID NO: 153184 - RNA, 1701 nt, Artificial Sequence; identical to SEQ ID NO: 153150
  derived and/or modified sequence opt4 from hemagglutinin__InfluenzaA__ABC85765

SEQ ID NO: 153185 - RNA, 1701 nt, Artificial Sequence
  derived and/or modified sequence opt4 from hemagglutinin__InfluenzaA__ABC85776
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacuucaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153186 - RNA, 1701 nt, Artificial Sequence; identical to SEQ ID NO: 153170
  derived and/or modified sequence opt4 from hemagglutinin__InfluenzaA__ABC85787

SEQ ID NO: 153187 - RNA, 1701 nt, Artificial Sequence; identical to SEQ ID NO: 153153
  derived and/or modified sequence opt4 from hemagglutinin__InfluenzaA__ABC85798

SEQ ID NO: 153188 - RNA, 1701 nt, Artificial Sequence; identical to SEQ ID NO: 153150
  derived and/or modified sequence opt4 from hemagglutinin__InfluenzaA__ABC85820

SEQ ID NO: 153189 - RNA, 1701 nt, Artificial Sequence; identical to SEQ ID NO: 153150
  derived and/or modified sequence opt4 from hemagglutinin__InfluenzaA__ABC85831

SEQ ID NO: 153190 - RNA, 1701 nt, Artificial Sequence; identical to SEQ ID NO: 153153
  derived and/or modified sequence opt4 from hemagglutinin__InfluenzaA__ABC85842

SEQ ID NO: 153191 - RNA, 1701 nt, Artificial Sequence; identical to SEQ ID NO: 153150
  derived and/or modified sequence opt4 from hemagglutinin__InfluenzaA__ABC85853

SEQ ID NO: 153192 - RNA, 1701 nt, Artificial Sequence; identical to SEQ ID NO: 153150
  derived and/or modified sequence opt4 from hemagglutinin__InfluenzaA__ABC85864

SEQ ID NO: 153193 - RNA, 1701 nt, Artificial Sequence; identical to SEQ ID NO: 153153
  derived and/or modified sequence opt4 from hemagglutinin__InfluenzaA__ABC85886

SEQ ID NO: 153194 - RNA, 1701 nt, Artificial Sequence; identical to SEQ ID NO: 153082
  derived and/or modified sequence opt4 from hemagglutinin__InfluenzaA__ABC85908

SEQ ID NO: 153195 - RNA, 1701 nt, Artificial Sequence
  derived and/or modified sequence opt4 from hemagglutinin__InfluenzaA__ABC85919
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugaugggcuucaucaugugggccugccagaagggcaacaucagaugcaacaucugcaucuga

SEQ ID NO: 153196 - RNA, 1701 nt, Artificial Sequence; identical to SEQ ID NO: 153082
  derived and/or modified sequence opt4 from hemagglutinin__InfluenzaA__ABC85930

SEQ ID NO: 153197 - RNA, 1701 nt, Artificial Sequence; identical to SEQ ID NO: 153131
  derived and/or modified sequence opt4 from hemagglutinin__InfluenzaA__ABC85941

SEQ ID NO: 153198 - RNA, 1701 nt, Artificial Sequence
  derived and/or modified sequence opt4 from hemagglutinin__InfluenzaA__ABC85952
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccacaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153199 - RNA, 1701 nt, Artificial Sequence; identical to SEQ ID NO: 153082
  derived and/or modified sequence opt4 from hemagglutinin__InfluenzaA__ABC85974

SEQ ID NO: 153200 - RNA, 1701 nt, Artificial Sequence; identical to SEQ ID NO: 153082
  derived and/or modified sequence opt4 from hemagglutinin__InfluenzaA__ABC85985

SEQ ID NO: 153201 - RNA, 1701 nt, Artificial Sequence
  derived and/or modified sequence opt4 from hemagglutinin__InfluenzaA__ABC85996
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153202 - RNA, 1701 nt, Artificial Sequence; identical to SEQ ID NO: 152763
  derived and/or modified sequence opt4 from hemagglutinin__InfluenzaA__ABC86007

SEQ ID NO: 153203 - RNA, 1701 nt, Artificial Sequence
  derived and/or modified sequence opt4 from hemagglutinin__InfluenzaA__ABC86018
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcaccaucaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153204 - RNA, 1701 nt, Artificial Sequence; identical to SEQ ID NO: 152763
  derived and/or modified sequence opt4 from hemagglutinin__InfluenzaA__ABC86029

SEQ ID NO: 153205 - RNA, 1701 nt, Artificial Sequence; identical to SEQ ID NO: 152802
  derived and/or modified sequence opt4 from hemagglutinin__InfluenzaA__ABC86040

SEQ ID NO: 153206 - RNA, 1701 nt, Artificial Sequence; identical to SEQ ID NO: 153036
  derived and/or modified sequence opt4 from hemagglutinin__InfluenzaA__ABC86124

SEQ ID NO: 153207 - RNA, 1701 nt, Artificial Sequence; identical to SEQ ID NO: 153113
  derived and/or modified sequence opt4 from hemagglutinin__InfluenzaA__ABC86137

SEQ ID NO: 153208 - RNA, 1701 nt, Artificial Sequence
  derived and/or modified sequence opt4 from hemagglutinin__InfluenzaA__ABC97374
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153209 - RNA, 1701 nt, Artificial Sequence; identical to SEQ ID NO: 152552
  derived and/or modified sequence opt4 from hemagglutinin__InfluenzaA__ABD15449

SEQ ID NO: 153210 - RNA, 1701 nt, Artificial Sequence
  derived and/or modified sequence opt4 from hemagglutinin__InfluenzaA__ABD15460
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagccccuaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153211 - RNA, 1701 nt, Artificial Sequence; identical to SEQ ID NO: 152552
  derived and/or modified sequence opt4 from hemagglutinin__InfluenzaA__ABD15471

SEQ ID NO: 153212 - RNA, 1701 nt, Artificial Sequence; identical to SEQ ID NO: 152552
  derived and/or modified sequence opt4 from hemagglutinin__InfluenzaA__ABD15482

SEQ ID NO: 153213 - RNA, 1701 nt, Artificial Sequence; identical to SEQ ID NO: 153210
  derived and/or modified sequence opt4 from hemagglutinin__InfluenzaA__ABD15493

SEQ ID NO: 153214 - RNA, 1701 nt, Artificial Sequence; identical to SEQ ID NO: 152763
  derived and/or modified sequence opt4 from hemagglutinin__InfluenzaA__ABD15526

SEQ ID NO: 153215 - RNA, 1701 nt, Artificial Sequence; identical to SEQ ID NO: 152972
  derived and/or modified sequence opt4 from hemagglutinin__InfluenzaA__ABD15537

SEQ ID NO: 153216 - RNA, 1701 nt, Artificial Sequence; identical to SEQ ID NO: 152972
  derived and/or modified sequence opt4 from hemagglutinin__InfluenzaA__ABD15548

SEQ ID NO: 153217 - RNA, 1701 nt, Artificial Sequence; identical to SEQ ID NO: 152990
  derived and/or modified sequence opt4 from hemagglutinin__InfluenzaA__ABD15559

SEQ ID NO: 153218 - RNA, 1701 nt, Artificial Sequence; identical to SEQ ID NO: 152972
  derived and/or modified sequence opt4 from hemagglutinin__InfluenzaA__ABD15570

SEQ ID NO: 153219 - RNA, 1701 nt, Artificial Sequence; identical to SEQ ID NO: 152990
  derived and/or modified sequence opt4 from hemagglutinin__InfluenzaA__ABD15581

SEQ ID NO: 153220 - RNA, 1701 nt, Artificial Sequence; identical to SEQ ID NO: 152972
  derived and/or modified sequence opt4 from hemagglutinin__InfluenzaA__ABD15592

SEQ ID NO: 153221 - RNA, 1701 nt, Artificial Sequence; identical to SEQ ID NO: 152972
  derived and/or modified sequence opt4 from hemagglutinin__InfluenzaA__ABD15603

SEQ ID NO: 153222 - RNA, 1701 nt, Artificial Sequence; identical to SEQ ID NO: 152972
  derived and/or modified sequence opt4 from hemagglutinin__InfluenzaA__ABD15614

SEQ ID NO: 153223 - RNA, 1701 nt, Artificial Sequence
  derived and/or modified sequence opt4 from hemagglutinin__InfluenzaA__ABD15625
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagccagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggugaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153224 - RNA, 1701 nt, Artificial Sequence; identical to SEQ ID NO: 152990
  derived and/or modified sequence opt4 from hemagglutinin__InfluenzaA__ABD15636

SEQ ID NO: 153225 - RNA, 1701 nt, Artificial Sequence; identical to SEQ ID NO: 153170
  derived and/or modified sequence opt4 from hemagglutinin__InfluenzaA__ABD15680

SEQ ID NO: 153226 - RNA, 1701 nt, Artificial Sequence
  derived and/or modified sequence opt4 from hemagglutinin__InfluenzaA__ABD15691
augaagaccaucaucgcccugagcuacauccugugccugguguucgcccagaagcugcccgugaacgacaagagcaccgccacccugugccugggccaccacgccgugcccaacggcacccuggugaagaccaucaccaacgaccacaucgaggugaccaacgccaccgagcuggugcagagcagccccaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153227 - RNA, 1701 nt, Artificial Sequence
  derived and/or modified sequence opt4 from hemagglutinin__InfluenzaA__ABD15702
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaccagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153228 - RNA, 1701 nt, Artificial Sequence
  derived and/or modified sequence opt4 from hemagglutinin__InfluenzaA__ABD15724
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacguggccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153229 - RNA, 1701 nt, Artificial Sequence
  derived and/or modified sequence opt4 from hemagglutinin__InfluenzaA__ABD15746
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggagaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153230 - RNA, 1701 nt, Artificial Sequence
  derived and/or modified sequence opt4 from hemagglutinin__InfluenzaA__ABD15757
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggagaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153231 - RNA, 1701 nt, Artificial Sequence; identical to SEQ ID NO: 153170
  derived and/or modified sequence opt4 from hemagglutinin__InfluenzaA__ABD15779

SEQ ID NO: 153232 - RNA, 1701 nt, Artificial Sequence; identical to SEQ ID NO: 153170
  derived and/or modified sequence opt4 from hemagglutinin__InfluenzaA__ABD15790

SEQ ID NO: 153233 - RNA, 1701 nt, Artificial Sequence; identical to SEQ ID NO: 153170
  derived and/or modified sequence opt4 from hemagglutinin__InfluenzaA__ABD16292

SEQ ID NO: 153234 - RNA, 1701 nt, Artificial Sequence; identical to SEQ ID NO: 153153
  derived and/or modified sequence opt4 from hemagglutinin__InfluenzaA__ABD16303

SEQ ID NO: 153235 - RNA, 1701 nt, Artificial Sequence; identical to SEQ ID NO: 153153
  derived and/or modified sequence opt4 from hemagglutinin__InfluenzaA__ABD16325

SEQ ID NO: 153236 - RNA, 1701 nt, Artificial Sequence
  derived and/or modified sequence opt4 from hemagglutinin__InfluenzaA__ABD16336
augaagaccaucaucgcccugagcuacacccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153237 - RNA, 1701 nt, Artificial Sequence; identical to SEQ ID NO: 153153
  derived and/or modified sequence opt4 from hemagglutinin__InfluenzaA__ABD16347

SEQ ID NO: 153238 - RNA, 1701 nt, Artificial Sequence
  derived and/or modified sequence opt4 from hemagglutinin__InfluenzaA__ABD16358
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgaccuggagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153239 - RNA, 1701 nt, Artificial Sequence; identical to SEQ ID NO: 153153
  derived and/or modified sequence opt4 from hemagglutinin__InfluenzaA__ABD16472

SEQ ID NO: 153240 - RNA, 1701 nt, Artificial Sequence; identical to SEQ ID NO: 153153
  derived and/or modified sequence opt4 from hemagglutinin__InfluenzaA__ABD16483

SEQ ID NO: 153241 - RNA, 1701 nt, Artificial Sequence; identical to SEQ ID NO: 153150
  derived and/or modified sequence opt4 from hemagglutinin__InfluenzaA__ABD16494

SEQ ID NO: 153242 - RNA, 1701 nt, Artificial Sequence; identical to SEQ ID NO: 153153
  derived and/or modified sequence opt4 from hemagglutinin__InfluenzaA__ABD16505

SEQ ID NO: 153243 - RNA, 1701 nt, Artificial Sequence
  derived and/or modified sequence opt4 from hemagglutinin__InfluenzaA__ABD16516
augaagaccaucaucgcccugagcuacauccugugcaugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153244 - RNA, 1701 nt, Artificial Sequence
  derived and/or modified sequence opt4 from hemagglutinin__InfluenzaA__ABD16527
augaagaccaucaucgcccugagcuacauccugugccugguguucgcccagaagcugcccgagaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 153245 - RNA, 1701 nt, Artificial Sequence; identical to SEQ ID NO: 153036
  derived and/or modified sequence opt4 from hemagglutinin__InfluenzaA__ABD16538

SEQ ID NO: 153246 - RNA, 1701 nt, Artificial Sequence
  derived and/or modified sequence opt4 from hemagglutinin__InfluenzaA__ABD16549
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucgugugggccugccagaagggcaacaucagaugcaacaucugcaucuga

SEQ ID NO: 153247 - RNA, 1701 nt, Artificial Sequence; identical to SEQ ID NO: 153150
  derived and/or modified sequence opt4 from hemagglutinin__InfluenzaA__ABD16560

SEQ ID NO: 153248 - RNA, 1701 nt, Artificial Sequence
  derived and/or modified sequence opt4 from hemagglutinin__InfluenzaA__ABD16571
augaagaccaucaucgcccugagcuacaucuucugccuggugguggcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcagaaucugcaacagcccccacagaauccuggacggcaagaacugcacccugaucgacgcccugcugggcgacccccacugcgacagcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153249 - RNA, 1701 nt, Artificial Sequence
  derived and/or modified sequence opt4 from hemagglutinin__InfluenzaA__ABD16718
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucaucgagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgaguacaaguaccccgcccugaacgugaccaugcccaacaacggcaaguucgacaagcuguacaucuggggcgugcaccaccccaucaccgagaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153250 - RNA, 1701 nt, Artificial Sequence
  derived and/or modified sequence opt4 from hemagglutinin__InfluenzaA__ABD16729
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcuacaccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcaaggugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153251 - RNA, 1701 nt, Artificial Sequence
  derived and/or modified sequence opt4 from hemagglutinin__InfluenzaA__ABD16751
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcacagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153252 - RNA, 1701 nt, Artificial Sequence; identical to SEQ ID NO: 153113
  derived and/or modified sequence opt4 from hemagglutinin__InfluenzaA__ABD16762

SEQ ID NO: 153253 - RNA, 1701 nt, Artificial Sequence; identical to SEQ ID NO: 152825
  derived and/or modified sequence opt4 from hemagglutinin__InfluenzaA__ABD17323

SEQ ID NO: 153254 - RNA, 1701 nt, Artificial Sequence; identical to SEQ ID NO: 153082
  derived and/or modified sequence opt4 from hemagglutinin__InfluenzaA__ABD38134

SEQ ID NO: 153255 - RNA, 1698 nt, Artificial Sequence; identical to SEQ ID NO: 152821
  derived and/or modified sequence opt4 from hemagglutinin__InfluenzaA__ABD60779

SEQ ID NO: 153256 - RNA, 1701 nt, Artificial Sequence
  derived and/or modified sequence opt4 from hemagglutinin__InfluenzaA__ABD60790
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccugaucaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagaaucaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153257 - RNA, 1701 nt, Artificial Sequence
  derived and/or modified sequence opt4 from hemagglutinin__InfluenzaA__ABD60801
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagacugugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcagaagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccagagcagcagaaugagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagcacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153258 - RNA, 1701 nt, Artificial Sequence
  derived and/or modified sequence opt4 from hemagglutinin__InfluenzaA__ABD60812
augaagaccaucaucgcccugagcuacauccugugccugaucuucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccagcaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153259 - RNA, 1701 nt, Artificial Sequence; identical to SEQ ID NO: 153153
  derived and/or modified sequence opt4 from hemagglutinin__InfluenzaA__ABD60823

SEQ ID NO: 153260 - RNA, 1701 nt, Artificial Sequence
  derived and/or modified sequence opt4 from hemagglutinin__InfluenzaA__ABD60845
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaccaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugacccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccugaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153261 - RNA, 1698 nt, Artificial Sequence
  derived and/or modified sequence opt4 from hemagglutinin__InfluenzaA__ABD60878
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153262 - RNA, 1698 nt, Artificial Sequence
  derived and/or modified sequence opt4 from hemagglutinin__InfluenzaA__ABD60889
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153263 - RNA, 1698 nt, Artificial Sequence
  derived and/or modified sequence opt4 from hemagglutinin__InfluenzaA__ABD60900
augaaggugaagagacuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153264 - RNA, 1698 nt, Artificial Sequence
  derived and/or modified sequence opt4 from hemagglutinin__InfluenzaA__ABD60911
augaaggccaagcugauggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucgacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153265 - RNA, 1701 nt, Artificial Sequence; identical to SEQ ID NO: 152552
  derived and/or modified sequence opt4 from hemagglutinin__InfluenzaA__ABD60922

SEQ ID NO: 153266 - RNA, 1701 nt, Artificial Sequence
  derived and/or modified sequence opt4 from hemagglutinin__InfluenzaA__ABD60933
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuggugagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugaacagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153267 - RNA, 1701 nt, Artificial Sequence
  derived and/or modified sequence opt4 from hemagglutinin__InfluenzaA__ABD60944
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153268 - RNA, 1701 nt, Artificial Sequence
  derived and/or modified sequence opt4 from hemagglutinin__InfluenzaA__ABD60955
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccaagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccaccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucagagaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacggcagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagaggcaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153269 - RNA, 1701 nt, Artificial Sequence; identical to SEQ ID NO: 152552
  derived and/or modified sequence opt4 from hemagglutinin__InfluenzaA__ABD61260

SEQ ID NO: 153270 - RNA, 1701 nt, Artificial Sequence; identical to SEQ ID NO: 152552
  derived and/or modified sequence opt4 from hemagglutinin__InfluenzaA__ABD61271

SEQ ID NO: 153271 - RNA, 1701 nt, Artificial Sequence; identical to SEQ ID NO: 152806
  derived and/or modified sequence opt4 from hemagglutinin__InfluenzaA__ABD61282

SEQ ID NO: 153272 - RNA, 1701 nt, Artificial Sequence; identical to SEQ ID NO: 153036
  derived and/or modified sequence opt4 from hemagglutinin__InfluenzaA__ABD61293

SEQ ID NO: 153273 - RNA, 1701 nt, Artificial Sequence; identical to SEQ ID NO: 153258
  derived and/or modified sequence opt4 from hemagglutinin__InfluenzaA__ABD61304

SEQ ID NO: 153274 - RNA, 1701 nt, Artificial Sequence; identical to SEQ ID NO: 153170
  derived and/or modified sequence opt4 from hemagglutinin__InfluenzaA__ABD61315

SEQ ID NO: 153275 - RNA, 1701 nt, Artificial Sequence; identical to SEQ ID NO: 152592
  derived and/or modified sequence opt4 from hemagglutinin__InfluenzaA__ABD61337

SEQ ID NO: 153276 - RNA, 1701 nt, Artificial Sequence
  derived and/or modified sequence opt4 from hemagglutinin__InfluenzaA__ABD61348
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacaacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153277 - RNA, 1701 nt, Artificial Sequence; identical to SEQ ID NO: 152592
  derived and/or modified sequence opt4 from hemagglutinin__InfluenzaA__ABD61359

SEQ ID NO: 153278 - RNA, 1701 nt, Artificial Sequence; identical to SEQ ID NO: 153230
  derived and/or modified sequence opt4 from hemagglutinin__InfluenzaA__ABD61370

SEQ ID NO: 153279 - RNA, 1701 nt, Artificial Sequence; identical to SEQ ID NO: 153170
  derived and/or modified sequence opt4 from hemagglutinin__InfluenzaA__ABD61381

SEQ ID NO: 153280 - RNA, 1701 nt, Artificial Sequence
  derived and/or modified sequence opt4 from hemagglutinin__InfluenzaA__ABD61392
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaggcagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153281 - RNA, 1701 nt, Artificial Sequence; identical to SEQ ID NO: 153260
  derived and/or modified sequence opt4 from hemagglutinin__InfluenzaA__ABD61403

SEQ ID NO: 153282 - RNA, 1701 nt, Artificial Sequence
  derived and/or modified sequence opt4 from hemagglutinin__InfluenzaA__ABD61529
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgugcugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcagacugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153283 - RNA, 1698 nt, Artificial Sequence; identical to SEQ ID NO: 153261
  derived and/or modified sequence opt4 from hemagglutinin__InfluenzaA__ABD61540

SEQ ID NO: 153284 - RNA, 1701 nt, Artificial Sequence
  derived and/or modified sequence opt4 from hemagglutinin__InfluenzaA__ABD61757
augaagaccaucaucgcccugagcuacaucuucugccugguguucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaagccagcagaccgugauccccaacgugggcagcagacccugggugagaggccugagcagcagagugagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153285 - RNA, 1701 nt, Artificial Sequence
  derived and/or modified sequence opt4 from hemagglutinin__InfluenzaA__ABD61777
augaagaccaucaucgcccugagcuacaucuucugccugggcuucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153286 - RNA, 1701 nt, Artificial Sequence
  derived and/or modified sequence opt4 from hemagglutinin__InfluenzaA__ABD77598
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagccccaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153287 - RNA, 1701 nt, Artificial Sequence; identical to SEQ ID NO: 153170
  derived and/or modified sequence opt4 from hemagglutinin__InfluenzaA__ABD77609

SEQ ID NO: 153288 - RNA, 1701 nt, Artificial Sequence; identical to SEQ ID NO: 153170
  derived and/or modified sequence opt4 from hemagglutinin__InfluenzaA__ABD77620

SEQ ID NO: 153289 - RNA, 1701 nt, Artificial Sequence; identical to SEQ ID NO: 153170
  derived and/or modified sequence opt4 from hemagglutinin__InfluenzaA__ABD77631

SEQ ID NO: 153290 - RNA, 1701 nt, Artificial Sequence; identical to SEQ ID NO: 153170
  derived and/or modified sequence opt4 from hemagglutinin__InfluenzaA__ABD77642

SEQ ID NO: 153291 - RNA, 1701 nt, Artificial Sequence; identical to SEQ ID NO: 153170
  derived and/or modified sequence opt4 from hemagglutinin__InfluenzaA__ABD77653

SEQ ID NO: 153292 - RNA, 1698 nt, Artificial Sequence; identical to SEQ ID NO: 153261
  derived and/or modified sequence opt4 from hemagglutinin__InfluenzaA__ABD77708

SEQ ID NO: 153293 - RNA, 1698 nt, Artificial Sequence
  derived and/or modified sequence opt4 from hemagglutinin__InfluenzaA__ABD77719
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagaaaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153294 - RNA, 1698 nt, Artificial Sequence; identical to SEQ ID NO: 153261
  derived and/or modified sequence opt4 from hemagglutinin__InfluenzaA__ABD77730

SEQ ID NO: 153295 - RNA, 1701 nt, Artificial Sequence; identical to SEQ ID NO: 153170
  derived and/or modified sequence opt4 from hemagglutinin__InfluenzaA__ABD77752

SEQ ID NO: 153296 - RNA, 1701 nt, Artificial Sequence; identical to SEQ ID NO: 153170
  derived and/or modified sequence opt4 from hemagglutinin__InfluenzaA__ABD77763

SEQ ID NO: 153297 - RNA, 1701 nt, Artificial Sequence
  derived and/or modified sequence opt4 from hemagglutinin__InfluenzaA__ABD77774
augaagaccaucaucgcccugagcuacauccugugccugguguucgcccagaagcugcccgugaacgacaacagcaccgccacccugugccugggccaccacgccgugcccaacggcacccuggugaagaccaucaccaacgacaacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccagaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153298 - RNA, 1701 nt, Artificial Sequence; identical to SEQ ID NO: 153297
  derived and/or modified sequence opt4 from hemagglutinin__InfluenzaA__ABD77785

SEQ ID NO: 153299 - RNA, 1701 nt, Artificial Sequence
  derived and/or modified sequence opt4 from hemagglutinin__InfluenzaA__ABD77807
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcaccugcuaccccggcgacuucgccgacuacgaggagcugagagagcagcugagcagcgugagcagcuucgagagauucgagaucuuccccaaggagagaagcuggcccaagcacaacaucaccagaggcgugaccgccgccugcagccacgccggcaagagcagcuucuacaagaaccugcuguggcugaccgagaccaacggcagcuaccccaagcugagcaagagcuacgugaacaacaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaugaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugaagagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153300 - RNA, 1701 nt, Artificial Sequence
  derived and/or modified sequence opt4 from hemagglutinin__InfluenzaA__ABD77818
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaccgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagagcaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153301 - RNA, 1701 nt, Artificial Sequence
  derived and/or modified sequence opt4 from hemagglutinin__InfluenzaA__ABD77829
augaagaccaucaucgcccugagcuacauccuguaccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagacugugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153302 - RNA, 1701 nt, Artificial Sequence
  derived and/or modified sequence opt4 from hemagglutinin__InfluenzaA__ABD77862
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagcaucuacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153303 - RNA, 1701 nt, Artificial Sequence
  derived and/or modified sequence opt4 from hemagglutinin__InfluenzaA__ABD77884
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagggcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153304 - RNA, 1701 nt, Artificial Sequence
  derived and/or modified sequence opt4 from hemagglutinin__InfluenzaA__ABD77895
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucagcggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153305 - RNA, 1701 nt, Artificial Sequence; identical to SEQ ID NO: 153303
  derived and/or modified sequence opt4 from hemagglutinin__InfluenzaA__ABD77906

SEQ ID NO: 153306 - RNA, 1698 nt, Artificial Sequence
  derived and/or modified sequence opt4 from hemagglutinin__InfluenzaA__ABD77917
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153307 - RNA, 1698 nt, Artificial Sequence
  derived and/or modified sequence opt4 from hemagglutinin__InfluenzaA__ABD77928
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaagaaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153308 - RNA, 1698 nt, Artificial Sequence; identical to SEQ ID NO: 153262
  derived and/or modified sequence opt4 from hemagglutinin__InfluenzaA__ABD77939

SEQ ID NO: 153309 - RNA, 1698 nt, Artificial Sequence; identical to SEQ ID NO: 153262
  derived and/or modified sequence opt4 from hemagglutinin__InfluenzaA__ABD77950

SEQ ID NO: 153310 - RNA, 1698 nt, Artificial Sequence; identical to SEQ ID NO: 153261
  derived and/or modified sequence opt4 from hemagglutinin__InfluenzaA__ABD77961

SEQ ID NO: 153311 - RNA, 1698 nt, Artificial Sequence; identical to SEQ ID NO: 153262
  derived and/or modified sequence opt4 from hemagglutinin__InfluenzaA__ABD77983

SEQ ID NO: 153312 - RNA, 1698 nt, Artificial Sequence; identical to SEQ ID NO: 153262
  derived and/or modified sequence opt4 from hemagglutinin__InfluenzaA__ABD77994

SEQ ID NO: 153313 - RNA, 1698 nt, Artificial Sequence; identical to SEQ ID NO: 153261
  derived and/or modified sequence opt4 from hemagglutinin__InfluenzaA__ABD78005

SEQ ID NO: 153314 - RNA, 1698 nt, Artificial Sequence; identical to SEQ ID NO: 153261
  derived and/or modified sequence opt4 from hemagglutinin__InfluenzaA__ABD78016

SEQ ID NO: 153315 - RNA, 1698 nt, Artificial Sequence; identical to SEQ ID NO: 153262
  derived and/or modified sequence opt4 from hemagglutinin__InfluenzaA__ABD78027

SEQ ID NO: 153316 - RNA, 1698 nt, Artificial Sequence; identical to SEQ ID NO: 153262
  derived and/or modified sequence opt4 from hemagglutinin__InfluenzaA__ABD78038

SEQ ID NO: 153317 - RNA, 1701 nt, Artificial Sequence; identical to SEQ ID NO: 153297
  derived and/or modified sequence opt4 from hemagglutinin__InfluenzaA__ABD78049

SEQ ID NO: 153318 - RNA, 1698 nt, Artificial Sequence; identical to SEQ ID NO: 152816
  derived and/or modified sequence opt4 from hemagglutinin__InfluenzaA__ABD78060

SEQ ID NO: 153319 - RNA, 1698 nt, Artificial Sequence
  derived and/or modified sequence opt4 from hemagglutinin__InfluenzaA__ABD78071
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcggcggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153320 - RNA, 1698 nt, Artificial Sequence
  derived and/or modified sequence opt4 from hemagglutinin__InfluenzaA__ABD78093
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153321 - RNA, 1701 nt, Artificial Sequence
  derived and/or modified sequence opt4 from hemagglutinin__InfluenzaA__ABD78115
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagaaacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153322 - RNA, 1701 nt, Artificial Sequence
  derived and/or modified sequence opt4 from hemagglutinin__InfluenzaA__ABD78126
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153323 - RNA, 1701 nt, Artificial Sequence
  derived and/or modified sequence opt4 from hemagglutinin__InfluenzaA__ABD79032
augaagaccaucaucgcccugagcuacaucuucugccuggugcugggccaggacuuccccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucagcgagggcuucaccuggaccggcgugacccagaacggcggcagcaacgccugcaagagaggccccgacaucggcuucuucagcagacugaacuggcuguacaagagcggcagcaccuaccccgugcugaacgugaccaugcccaacaacgacaacuucgacaagcuguacaucuggggcgugcaccaccccagcaccgaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucagcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153324 - RNA, 1701 nt, Artificial Sequence
  derived and/or modified sequence opt4 from hemagglutinin__InfluenzaA__ABD79112
augaaggccaagcugcugauccugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccugcugagcaagagaagcuggagcuacaucgccgagacccccaacagcgagaacggcgccugcuaccccggcgacuucgccgacuacgaggagcugagagagcagcugagcagcgugagcagcuucgagagauucgagaucuuccccaagggcagaagcuggcccgagcacaacaucgacaucggcgugaccgccgccugcagccacgccggcaagagcagcuucuacaagaaccugcuguggcugaccgagaaggacggcagcuaccccaaccugaacaagagcuacgugaacaagaaggagaaggaggugcugauccuguggggcgugcaccacccccccaacaucgagaaccagaagacccuguacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccugguacgccuucgcccugaacagaggcaucggcagcggcaucaucaccagcaacgccagcauggacgagugcgacaccaagugccagaccccccagggcgccaucaacagcagccugcccuuccagaacauccaccccuucaccaucggcgagugccccaaguacgugagaagcaccaagcugagaauggugaccggccugagaaacauccccagcauccagagcagaggccuguucggcgccaucgccggcuucaucgagggcggcugggacggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugagaaacaacgccaaggagaucggcaacggcugcuucgaguucuaccacaagugcaacaacgagugcauggagagcgugaagaacggcaccuacgacuaccccaaguucagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153325 - RNA, 1701 nt, Artificial Sequence
  derived and/or modified sequence opt4 from hemagglutinin__InfluenzaA__ABD79123
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153326 - RNA, 1701 nt, Artificial Sequence
  derived and/or modified sequence opt4 from hemagglutinin__InfluenzaA__ABD79134
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuuccagaacaagaagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153327 - RNA, 1701 nt, Artificial Sequence
  derived and/or modified sequence opt4 from hemagglutinin__InfluenzaA__ABD79145
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153328 - RNA, 1701 nt, Artificial Sequence; identical to SEQ ID NO: 153327
  derived and/or modified sequence opt4 from hemagglutinin__InfluenzaA__ABD79156

SEQ ID NO: 153329 - RNA, 1701 nt, Artificial Sequence; identical to SEQ ID NO: 152543
  derived and/or modified sequence opt4 from hemagglutinin__InfluenzaA__ABD79167

SEQ ID NO: 153330 - RNA, 1701 nt, Artificial Sequence; identical to SEQ ID NO: 153327
  derived and/or modified sequence opt4 from hemagglutinin__InfluenzaA__ABD79178

SEQ ID NO: 153331 - RNA, 1701 nt, Artificial Sequence
  derived and/or modified sequence opt4 from hemagglutinin__InfluenzaA__ABD79189
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccguggugaagcccggcgacauccugcugaucaacagcaccggcaaccugaucgcccccagaggcuacuucaagaucagaagcggcaagagcagcaucaugagaagcgacgcccccaucgacagcugcaacagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153332 - RNA, 1701 nt, Artificial Sequence; identical to SEQ ID NO: 153327
  derived and/or modified sequence opt4 from hemagglutinin__InfluenzaA__ABD79200

SEQ ID NO: 153333 - RNA, 1701 nt, Artificial Sequence
  derived and/or modified sequence opt4 from hemagglutinin__InfluenzaA__ABD79211
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaccaaggagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccuggaucagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcaucagcaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153334 - RNA, 1701 nt, Artificial Sequence; identical to SEQ ID NO: 152543
  derived and/or modified sequence opt4 from hemagglutinin__InfluenzaA__ABD79222

SEQ ID NO: 153335 - RNA, 1701 nt, Artificial Sequence; identical to SEQ ID NO: 152543
  derived and/or modified sequence opt4 from hemagglutinin__InfluenzaA__ABD79233

SEQ ID NO: 153336 - RNA, 1701 nt, Artificial Sequence
  derived and/or modified sequence opt4 from hemagglutinin__InfluenzaA__ABD79244
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153337 - RNA, 1701 nt, Artificial Sequence; identical to SEQ ID NO: 152763
  derived and/or modified sequence opt4 from hemagglutinin__InfluenzaA__ABD94734

SEQ ID NO: 153338 - RNA, 1701 nt, Artificial Sequence; identical to SEQ ID NO: 153150
  derived and/or modified sequence opt4 from hemagglutinin__InfluenzaA__ABD94745

SEQ ID NO: 153339 - RNA, 1701 nt, Artificial Sequence
  derived and/or modified sequence opt4 from hemagglutinin__InfluenzaA__ABD94767
augaagaccaucaucgcccugagcuacauccugugccugguguucgcccagaagcugcccgugaacgacaacagcaccgccacccugugccugggccaccacgccgugcccaacggcacccuggugaagaccaucaccaacgacaacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaacgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153340 - RNA, 1698 nt, Artificial Sequence; identical to SEQ ID NO: 153320
  derived and/or modified sequence opt4 from hemagglutinin__InfluenzaA__ABD94778

SEQ ID NO: 153341 - RNA, 1698 nt, Artificial Sequence; identical to SEQ ID NO: 153320
  derived and/or modified sequence opt4 from hemagglutinin__InfluenzaA__ABD94789

SEQ ID NO: 153342 - RNA, 1701 nt, Artificial Sequence
  derived and/or modified sequence opt4 from hemagglutinin__InfluenzaA__ABD94822
augaagaccaucaucgcccugagcuacauccugugccugguguucgcccagaagauccccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagcagcaucaagagcuucuucagcagacugaacuggcugcaccagcugaaguacaaguaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153343 - RNA, 1701 nt, Artificial Sequence
  derived and/or modified sequence opt4 from hemagglutinin__InfluenzaA__ABD94833
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcgacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153344 - RNA, 1701 nt, Artificial Sequence
  derived and/or modified sequence opt4 from hemagglutinin__InfluenzaA__ABD94844
augaagaccaucaucgcccugagcuacauccugugcaugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153345 - RNA, 1701 nt, Artificial Sequence
  derived and/or modified sequence opt4 from hemagglutinin__InfluenzaA__ABD94855
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagggcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153346 - RNA, 1701 nt, Artificial Sequence
  derived and/or modified sequence opt4 from hemagglutinin__InfluenzaA__ABD94866
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacggcccccaccagauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagagcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcagagcagcggcagaaucaccgugagcaccaagagaagccagcagaccgugacccccaacaucggcagcagacccugggugagaggcgugagcagcagaaucagcaucuacuggaccaucgugaagcccggcgacauccugcugaucaccagcaccggcaaccugaucgcccccagaggcuacuucaagaucagaagaggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153347 - RNA, 1701 nt, Artificial Sequence
  derived and/or modified sequence opt4 from hemagglutinin__InfluenzaA__ABD94877
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153348 - RNA, 1701 nt, Artificial Sequence
  derived and/or modified sequence opt4 from hemagglutinin__InfluenzaA__ABD94888
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuucaagaacaaggagugggaccuguucguggagagaagcaccgccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153349 - RNA, 1701 nt, Artificial Sequence; identical to SEQ ID NO: 153327
  derived and/or modified sequence opt4 from hemagglutinin__InfluenzaA__ABD94899

SEQ ID NO: 153350 - RNA, 1701 nt, Artificial Sequence
  derived and/or modified sequence opt4 from hemagglutinin__InfluenzaA__ABD94910
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153351 - RNA, 1701 nt, Artificial Sequence
  derived and/or modified sequence opt4 from hemagglutinin__InfluenzaA__ABD94921
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacggcccccaccagauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagagcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcagagcagcggcagagugaccgugagcaccaagagaagccagcagaccgugacccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagaggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153352 - RNA, 1701 nt, Artificial Sequence; identical to SEQ ID NO: 153327
  derived and/or modified sequence opt4 from hemagglutinin__InfluenzaA__ABD94932

SEQ ID NO: 153353 - RNA, 1698 nt, Artificial Sequence
  derived and/or modified sequence opt4 from hemagglutinin__InfluenzaA__ABD94943
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaagaagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153354 - RNA, 1701 nt, Artificial Sequence; identical to SEQ ID NO: 153153
  derived and/or modified sequence opt4 from hemagglutinin__InfluenzaA__ABD94954

SEQ ID NO: 153355 - RNA, 1698 nt, Artificial Sequence; identical to SEQ ID NO: 153262
  derived and/or modified sequence opt4 from hemagglutinin__InfluenzaA__ABD94965

SEQ ID NO: 153356 - RNA, 1698 nt, Artificial Sequence; identical to SEQ ID NO: 153261
  derived and/or modified sequence opt4 from hemagglutinin__InfluenzaA__ABD94987

SEQ ID NO: 153357 - RNA, 1698 nt, Artificial Sequence; identical to SEQ ID NO: 153261
  derived and/or modified sequence opt4 from hemagglutinin__InfluenzaA__ABD94998

SEQ ID NO: 153358 - RNA, 1698 nt, Artificial Sequence; identical to SEQ ID NO: 153261
  derived and/or modified sequence opt4 from hemagglutinin__InfluenzaA__ABD95009

SEQ ID NO: 153359 - RNA, 1698 nt, Artificial Sequence; identical to SEQ ID NO: 153262
  derived and/or modified sequence opt4 from hemagglutinin__InfluenzaA__ABD95020

SEQ ID NO: 153360 - RNA, 1698 nt, Artificial Sequence
  derived and/or modified sequence opt4 from hemagglutinin__InfluenzaA__ABD95031
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucaccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagaagaagcuacgccaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153361 - RNA, 1698 nt, Artificial Sequence
  derived and/or modified sequence opt4 from hemagglutinin__InfluenzaA__ABD95042
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaagggcaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153362 - RNA, 1698 nt, Artificial Sequence; identical to SEQ ID NO: 153361
  derived and/or modified sequence opt4 from hemagglutinin__InfluenzaA__ABD95053

SEQ ID NO: 153363 - RNA, 1698 nt, Artificial Sequence; identical to SEQ ID NO: 153320
  derived and/or modified sequence opt4 from hemagglutinin__InfluenzaA__ABD95064

SEQ ID NO: 153364 - RNA, 1698 nt, Artificial Sequence
  derived and/or modified sequence opt4 from hemagglutinin__InfluenzaA__ABD95075
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcaagggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153365 - RNA, 1698 nt, Artificial Sequence; identical to SEQ ID NO: 153361
  derived and/or modified sequence opt4 from hemagglutinin__InfluenzaA__ABD95086

SEQ ID NO: 153366 - RNA, 1698 nt, Artificial Sequence; identical to SEQ ID NO: 153320
  derived and/or modified sequence opt4 from hemagglutinin__InfluenzaA__ABD95097

SEQ ID NO: 153367 - RNA, 1698 nt, Artificial Sequence
  derived and/or modified sequence opt4 from hemagglutinin__InfluenzaA__ABD95119
augaaggccaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153368 - RNA, 1698 nt, Artificial Sequence
  derived and/or modified sequence opt4 from hemagglutinin__InfluenzaA__ABD95130
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggcagcuaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153369 - RNA, 1698 nt, Artificial Sequence; identical to SEQ ID NO: 153320
  derived and/or modified sequence opt4 from hemagglutinin__InfluenzaA__ABD95141

SEQ ID NO: 153370 - RNA, 1698 nt, Artificial Sequence; identical to SEQ ID NO: 153320
  derived and/or modified sequence opt4 from hemagglutinin__InfluenzaA__ABD95152

SEQ ID NO: 153371 - RNA, 1698 nt, Artificial Sequence; identical to SEQ ID NO: 153367
  derived and/or modified sequence opt4 from hemagglutinin__InfluenzaA__ABD95163

SEQ ID NO: 153372 - RNA, 1698 nt, Artificial Sequence; identical to SEQ ID NO: 153361
  derived and/or modified sequence opt4 from hemagglutinin__InfluenzaA__ABD95174

SEQ ID NO: 153373 - RNA, 1698 nt, Artificial Sequence
  derived and/or modified sequence opt4 from hemagglutinin__InfluenzaA__ABD95185
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153374 - RNA, 1698 nt, Artificial Sequence; identical to SEQ ID NO: 153361
  derived and/or modified sequence opt4 from hemagglutinin__InfluenzaA__ABD95196

SEQ ID NO: 153375 - RNA, 1698 nt, Artificial Sequence; identical to SEQ ID NO: 152819
  derived and/or modified sequence opt4 from hemagglutinin__InfluenzaA__ABD95207

SEQ ID NO: 153376 - RNA, 1698 nt, Artificial Sequence; identical to SEQ ID NO: 153320
  derived and/or modified sequence opt4 from hemagglutinin__InfluenzaA__ABD95218

SEQ ID NO: 153377 - RNA, 1698 nt, Artificial Sequence; identical to SEQ ID NO: 153367
  derived and/or modified sequence opt4 from hemagglutinin__InfluenzaA__ABD95229

SEQ ID NO: 153378 - RNA, 1698 nt, Artificial Sequence; identical to SEQ ID NO: 153320
  derived and/or modified sequence opt4 from hemagglutinin__InfluenzaA__ABD95240

SEQ ID NO: 153379 - RNA, 1698 nt, Artificial Sequence; identical to SEQ ID NO: 153361
  derived and/or modified sequence opt4 from hemagglutinin__InfluenzaA__ABD95251

SEQ ID NO: 153380 - RNA, 1698 nt, Artificial Sequence; identical to SEQ ID NO: 152819
  derived and/or modified sequence opt4 from hemagglutinin__InfluenzaA__ABD95262

SEQ ID NO: 153381 - RNA, 1698 nt, Artificial Sequence; identical to SEQ ID NO: 153320
  derived and/or modified sequence opt4 from hemagglutinin__InfluenzaA__ABD95273

SEQ ID NO: 153382 - RNA, 1698 nt, Artificial Sequence; identical to SEQ ID NO: 152816
  derived and/or modified sequence opt4 from hemagglutinin__InfluenzaA__ABD95284

SEQ ID NO: 153383 - RNA, 1698 nt, Artificial Sequence; identical to SEQ ID NO: 153320
  derived and/or modified sequence opt4 from hemagglutinin__InfluenzaA__ABD95295

SEQ ID NO: 153384 - RNA, 1698 nt, Artificial Sequence
  derived and/or modified sequence opt4 from hemagglutinin__InfluenzaA__ABD95306
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggagauccuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153385 - RNA, 1698 nt, Artificial Sequence; identical to SEQ ID NO: 153361
  derived and/or modified sequence opt4 from hemagglutinin__InfluenzaA__ABD95328

SEQ ID NO: 153386 - RNA, 1701 nt, Artificial Sequence
  derived and/or modified sequence opt4 from hemagglutinin__InfluenzaA__ABD95339
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacagcgugaccagaggcgugaccgccagcugcagccacaagggcaagagcagcuucuacagaaaccugcuguggcugaccgagaagaacggcagcuaccccaaccugagcaagagcuacgugaacgacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgugagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153387 - RNA, 1698 nt, Artificial Sequence; identical to SEQ ID NO: 153262
  derived and/or modified sequence opt4 from hemagglutinin__InfluenzaA__ABE11657

SEQ ID NO: 153388 - RNA, 1698 nt, Artificial Sequence
  derived and/or modified sequence opt4 from hemagglutinin__InfluenzaA__ABE11668
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153389 - RNA, 1698 nt, Artificial Sequence
  derived and/or modified sequence opt4 from hemagglutinin__InfluenzaA__ABE11679
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcagaaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153390 - RNA, 1698 nt, Artificial Sequence
  derived and/or modified sequence opt4 from hemagglutinin__InfluenzaA__ABE11690
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153391 - RNA, 1698 nt, Artificial Sequence
  derived and/or modified sequence opt4 from hemagglutinin__InfluenzaA__ABE11701
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagaaggcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153392 - RNA, 1698 nt, Artificial Sequence; identical to SEQ ID NO: 153320
  derived and/or modified sequence opt4 from hemagglutinin__InfluenzaA__ABE11712

SEQ ID NO: 153393 - RNA, 1698 nt, Artificial Sequence; identical to SEQ ID NO: 153361
  derived and/or modified sequence opt4 from hemagglutinin__InfluenzaA__ABE11723

SEQ ID NO: 153394 - RNA, 1698 nt, Artificial Sequence; identical to SEQ ID NO: 153367
  derived and/or modified sequence opt4 from hemagglutinin__InfluenzaA__ABE11734

SEQ ID NO: 153395 - RNA, 1698 nt, Artificial Sequence; identical to SEQ ID NO: 153320
  derived and/or modified sequence opt4 from hemagglutinin__InfluenzaA__ABE11812

SEQ ID NO: 153396 - RNA, 1698 nt, Artificial Sequence; identical to SEQ ID NO: 153361
  derived and/or modified sequence opt4 from hemagglutinin__InfluenzaA__ABE11823

SEQ ID NO: 153397 - RNA, 1698 nt, Artificial Sequence; identical to SEQ ID NO: 153361
  derived and/or modified sequence opt4 from hemagglutinin__InfluenzaA__ABE11834

SEQ ID NO: 153398 - RNA, 1698 nt, Artificial Sequence; identical to SEQ ID NO: 153361
  derived and/or modified sequence opt4 from hemagglutinin__InfluenzaA__ABE11845

SEQ ID NO: 153399 - RNA, 1698 nt, Artificial Sequence; identical to SEQ ID NO: 153367
  derived and/or modified sequence opt4 from hemagglutinin__InfluenzaA__ABE11856

SEQ ID NO: 153400 - RNA, 1701 nt, Artificial Sequence
  derived and/or modified sequence opt4 from hemagglutinin__InfluenzaA__ABE11900
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcugaucagccugggcgccaucagcuucuggaugugcagcaacggcagccugcagugcagaaucugcaucuga

SEQ ID NO: 153401 - RNA, 1701 nt, Artificial Sequence
  derived and/or modified sequence opt4 from hemagglutinin__InfluenzaA__ABE11942
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccagccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153402 - RNA, 1701 nt, Artificial Sequence
  derived and/or modified sequence opt4 from hemagglutinin__InfluenzaA__ABE12078
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 153403 - RNA, 1701 nt, Artificial Sequence; identical to SEQ ID NO: 153297
  derived and/or modified sequence opt4 from hemagglutinin__InfluenzaA__ABE12123

SEQ ID NO: 153404 - RNA, 1698 nt, Artificial Sequence; identical to SEQ ID NO: 153320
  derived and/or modified sequence opt4 from hemagglutinin__InfluenzaA__ABE12248

SEQ ID NO: 153405 - RNA, 1701 nt, Artificial Sequence
  derived and/or modified sequence opt4 from hemagglutinin__InfluenzaA__ABE12623
augaagaccaucaucgcccugagcuacaucuucugccuggugcugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacggcuuccagaacgagaccugggaccuguucguggagagaagcaaggccuucagcaacugcuaccccuacgacgugcccgacuacgccagccugagaagccugguggccagcagcggcacccuggaguucaucaacgagggcuucaccuggaccggcgugacccagaacggcggcagcaacgccugcaagagaggccccgacagcggcuucuucagcagacugaacuggcuguacaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucggcaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153406 - RNA, 1701 nt, Artificial Sequence; identical to SEQ ID NO: 153350
  derived and/or modified sequence opt4 from hemagglutinin__InfluenzaA__ABE12645

SEQ ID NO: 153407 - RNA, 1701 nt, Artificial Sequence; identical to SEQ ID NO: 153327
  derived and/or modified sequence opt4 from hemagglutinin__InfluenzaA__ABE13076

SEQ ID NO: 153408 - RNA, 1701 nt, Artificial Sequence; identical to SEQ ID NO: 153303
  derived and/or modified sequence opt4 from hemagglutinin__InfluenzaA__ABE13323

SEQ ID NO: 153409 - RNA, 1701 nt, Artificial Sequence
  derived and/or modified sequence opt4 from hemagglutinin__InfluenzaA__ABE13471
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucuacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153410 - RNA, 1701 nt, Artificial Sequence
  derived and/or modified sequence opt4 from hemagglutinin__InfluenzaA__ABE13555
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagggcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucagcagcaccggcaaccugaucgcccccagaggcuacuucaagaucagaagcggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccaagggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaugagcugcuuccugcugugcguggugcugcugggcuucaucaugugggccugccagaagggcaacaucagaugcaacaucugcaucuga

SEQ ID NO: 153411 - RNA, 1701 nt, Artificial Sequence
  derived and/or modified sequence opt4 from hemagglutinin__InfluenzaA__ABE13606
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagauggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugaucgcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153412 - RNA, 1701 nt, Artificial Sequence
  derived and/or modified sequence opt4 from hemagglutinin__InfluenzaA__ABE13628
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153413 - RNA, 1701 nt, Artificial Sequence
  derived and/or modified sequence opt4 from hemagglutinin__InfluenzaA__ABE13824
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153414 - RNA, 1701 nt, Artificial Sequence; identical to SEQ ID NO: 153413
  derived and/or modified sequence opt4 from hemagglutinin__InfluenzaA__ABE14019

SEQ ID NO: 153415 - RNA, 1701 nt, Artificial Sequence
  derived and/or modified sequence opt4 from hemagglutinin__InfluenzaA__ABE14030
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaucggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153416 - RNA, 1701 nt, Artificial Sequence; identical to SEQ ID NO: 153412
  derived and/or modified sequence opt4 from hemagglutinin__InfluenzaA__ABE14041

SEQ ID NO: 153417 - RNA, 1701 nt, Artificial Sequence; identical to SEQ ID NO: 153413
  derived and/or modified sequence opt4 from hemagglutinin__InfluenzaA__ABE14063

SEQ ID NO: 153418 - RNA, 1701 nt, Artificial Sequence
  derived and/or modified sequence opt4 from hemagglutinin__InfluenzaA__ABE14124
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugaucgcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153419 - RNA, 1701 nt, Artificial Sequence
  derived and/or modified sequence opt4 from hemagglutinin__InfluenzaA__ABE14464
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153420 - RNA, 1701 nt, Artificial Sequence
  derived and/or modified sequence opt4 from hemagglutinin__InfluenzaA__ABE14840
augaagaccaucaucgcccugagcuacauccugugccugguguucgcccagaagcugcccagaaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 153421 - RNA, 1701 nt, Artificial Sequence
  derived and/or modified sequence opt4 from hemagglutinin__InfluenzaA__ABE15578
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 153422 - RNA, 1701 nt, Artificial Sequence
  derived and/or modified sequence opt4 from hemagglutinin__InfluenzaA__ABE26991
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgacugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcacccugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153423 - RNA, 1701 nt, Artificial Sequence
  derived and/or modified sequence opt4 from hemagglutinin__InfluenzaA__ABF47550
augaagaccaucaucgcccugagcuacaucuucugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuacagcaacugcuaccccuacgacgugcccgacuacgccagccugagaagccugguggccagcagcggcacccuggaguucaucaacgaggacuucaacuggaccggcgugacccagagcggcggcagcuacgccugcaagagaggcagcgugaacagcuucuucagcagacugaacuggcugcacgagagcgaguacaaguaccccgcccugaacgugaccaugcccaacaacggcaaguucgacaagcuguacaucuggggcgugcaccaccccagcaccgacagagagcagaccaaccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcgagugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153424 - RNA, 1698 nt, Artificial Sequence
  derived and/or modified sequence opt4 from hemagglutinin__InfluenzaA__ABF47561
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaagcugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153425 - RNA, 1698 nt, Artificial Sequence
  derived and/or modified sequence opt4 from hemagglutinin__InfluenzaA__ABF47572
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggacaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153426 - RNA, 1698 nt, Artificial Sequence; identical to SEQ ID NO: 153320
  derived and/or modified sequence opt4 from hemagglutinin__InfluenzaA__ABF47583

SEQ ID NO: 153427 - RNA, 1701 nt, Artificial Sequence
  derived and/or modified sequence opt4 from hemagglutinin__InfluenzaA__ABF47594
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccagaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153428 - RNA, 1701 nt, Artificial Sequence
  derived and/or modified sequence opt4 from hemagglutinin__InfluenzaA__ABF47605
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccagcggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaaucgagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153429 - RNA, 1701 nt, Artificial Sequence; identical to SEQ ID NO: 153413
  derived and/or modified sequence opt4 from hemagglutinin__InfluenzaA__ABF47616

SEQ ID NO: 153430 - RNA, 1701 nt, Artificial Sequence
  derived and/or modified sequence opt4 from hemagglutinin__InfluenzaA__ABF47627
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgacugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153431 - RNA, 1701 nt, Artificial Sequence
  derived and/or modified sequence opt4 from hemagglutinin__InfluenzaA__ABF47638
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153432 - RNA, 1701 nt, Artificial Sequence; identical to SEQ ID NO: 153431
  derived and/or modified sequence opt4 from hemagglutinin__InfluenzaA__ABF47649

SEQ ID NO: 153433 - RNA, 1701 nt, Artificial Sequence
  derived and/or modified sequence opt4 from hemagglutinin__InfluenzaA__ABF47660
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcauccaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgacugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153434 - RNA, 1698 nt, Artificial Sequence
  derived and/or modified sequence opt4 from hemagglutinin__InfluenzaA__ABF47671
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuucgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153435 - RNA, 1701 nt, Artificial Sequence
  derived and/or modified sequence opt4 from hemagglutinin__InfluenzaA__ABF47693
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugaacagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153436 - RNA, 1701 nt, Artificial Sequence; identical to SEQ ID NO: 153435
  derived and/or modified sequence opt4 from hemagglutinin__InfluenzaA__ABF47704

SEQ ID NO: 153437 - RNA, 1701 nt, Artificial Sequence
  derived and/or modified sequence opt4 from hemagglutinin__InfluenzaA__ABF47715
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugaacagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153438 - RNA, 1701 nt, Artificial Sequence; identical to SEQ ID NO: 153435
  derived and/or modified sequence opt4 from hemagglutinin__InfluenzaA__ABF47726

SEQ ID NO: 153439 - RNA, 1701 nt, Artificial Sequence; identical to SEQ ID NO: 153435
  derived and/or modified sequence opt4 from hemagglutinin__InfluenzaA__ABF47737

SEQ ID NO: 153440 - RNA, 1701 nt, Artificial Sequence
  derived and/or modified sequence opt4 from hemagglutinin__InfluenzaA__ABF47748
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153441 - RNA, 1701 nt, Artificial Sequence
  derived and/or modified sequence opt4 from hemagglutinin__InfluenzaA__ABF47770
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153442 - RNA, 1701 nt, Artificial Sequence; identical to SEQ ID NO: 153441
  derived and/or modified sequence opt4 from hemagglutinin__InfluenzaA__ABF47781

SEQ ID NO: 153443 - RNA, 1701 nt, Artificial Sequence; identical to SEQ ID NO: 153441
  derived and/or modified sequence opt4 from hemagglutinin__InfluenzaA__ABF47792

SEQ ID NO: 153444 - RNA, 1701 nt, Artificial Sequence; identical to SEQ ID NO: 153441
  derived and/or modified sequence opt4 from hemagglutinin__InfluenzaA__ABF47803

SEQ ID NO: 153445 - RNA, 1701 nt, Artificial Sequence; identical to SEQ ID NO: 153441
  derived and/or modified sequence opt4 from hemagglutinin__InfluenzaA__ABF47814

SEQ ID NO: 153446 - RNA, 1701 nt, Artificial Sequence; identical to SEQ ID NO: 153441
  derived and/or modified sequence opt4 from hemagglutinin__InfluenzaA__ABF47825

SEQ ID NO: 153447 - RNA, 1701 nt, Artificial Sequence; identical to SEQ ID NO: 153441
  derived and/or modified sequence opt4 from hemagglutinin__InfluenzaA__ABF47836

SEQ ID NO: 153448 - RNA, 1701 nt, Artificial Sequence; identical to SEQ ID NO: 153441
  derived and/or modified sequence opt4 from hemagglutinin__InfluenzaA__ABF47847

SEQ ID NO: 153449 - RNA, 1701 nt, Artificial Sequence
  derived and/or modified sequence opt4 from hemagglutinin__InfluenzaA__ABF47858
augaagaccaucaucgcccugagcuacauccugugccugguguucgcccagaagcugcccggcaacgacaacggcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153450 - RNA, 1698 nt, Artificial Sequence; identical to SEQ ID NO: 153262
  derived and/or modified sequence opt4 from hemagglutinin__InfluenzaA__ABF47869

SEQ ID NO: 153451 - RNA, 1698 nt, Artificial Sequence; identical to SEQ ID NO: 153262
  derived and/or modified sequence opt4 from hemagglutinin__InfluenzaA__ABF47880

SEQ ID NO: 153452 - RNA, 1698 nt, Artificial Sequence
  derived and/or modified sequence opt4 from hemagglutinin__InfluenzaA__ABF47891
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccagaaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153453 - RNA, 1701 nt, Artificial Sequence
  derived and/or modified sequence opt4 from hemagglutinin__InfluenzaA__ABF47902
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagagcggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153454 - RNA, 1698 nt, Artificial Sequence
  derived and/or modified sequence opt4 from hemagglutinin__InfluenzaA__ABF47955
augaaggccaagcugcuggugcugcuguacgccuucguggccaccgacgccgacaccaucugcaucggcuaccacgccaacaacagcaccgacaccguggacaccaucuucgagaagaacguggccgugacccacagcgugaaccugcuggaggacagacacaacggcaagcugugcaagcugaagggcaucgccccccugcagcugggcaagugcaacaucaccggcuggcugcugggcaaccccgagugcgacagccugcugcccgccagaagcuggagcuacaucguggagacccccaacagcgagaacggcgccugcuaccccggcgacuucaucgacuacgaggagcugagagagcagcugagcagcgugagcagccuggagagauucgagaucuuccccaaggagagcagcuggcccaaccacaccuucaacggcgugaccgugagcugcagccacagaggcaagagcagcuucuacagaaaccugcuguggcugaccaagaagggcgacagcuaccccaagcugaccaacagcuacgugaacaacaagggcaaggaggugcuggugcuguggggcgugcaccaccccagcagcagcgacgagcagcagagccuguacagcaacggcaacgccuacgugagcguggccagcagcaacuacaacagaagauucacccccgagaucgccgccagacccaaggugaaggaccagcacggcagaaugaacuacuacuggacccugcuggagcccggcgacaccaucaucuucgaggccaccggcaaccugaucgcccccugguacgccuucgcccugagcagaggcuucgagagcggcaucaucaccagcaacgccagcaugcacgagugcaacaccaagugccagaccccccagggcagcaucaacagcaaccugcccuuccagaacauccaccccgugaccaucggcgagugccccaaguacgugagaagcaccaagcugagaauggugaccggccugagaaacauccccagcauccaguacagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacagaaucaccaacaaggugaacagcgugaucgagaagaugaacacccaguucaccgccgugggcaaggaguucaacaaccuggagaagagaauggagaaccugaacaagaagguggacgacggcuuccuggacaucuggaccuacaacgccgagcugcuggugcugcuggagaacgagagaacccuggacuuccacgaccugaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153455 - RNA, 1698 nt, Artificial Sequence
  derived and/or modified sequence opt4 from hemagglutinin__InfluenzaA__ABF60576
augaagaccaccaucauccugauccugcugacccacgccguggacagccagaaccccaucagcggcaacaacaccgccacccugugccugggccaccacgccguggccaacggcacccuggugaagaccaucaccgacgaccagaucgaggugaccaacgccaccgagcuggugcagagcaccagcaucggcaagaucugcaacaaccccuacagagugcuggacggcagaaacugcacccugaucgacgccaugcugggcgacccccacugcgacguguuccaguacgagaacugggaccuguucaucgagagaagcagcgccuucagcaacugcuaccccuacgacauccccgacuacgccagccugagaagcaucguggccagcagcggcacccuggaguucaccgccgagggcuucaccuggaccggcgugacccagaacggcggcagcggcgccugcagaagaggcagcgccgacagcuucuucagcagacugaacuggcugaccaagagcggcaacagcuaccccacccugaacgugaccaugcccaacaacgacaacuucgacaagcuguacaucuggggcauccaccaccccagcaccaacaacgagcagaccaagcuguacgugcaggagcugggcagagugaccgugagcaccaagagaagccagcagaccaucauccccaacaucggcagcagacccggcgugagaggccaggccggcagaaucagcaucuacuggaccaucgugaagcccggcgacauccugaugaucaacagcaacggcaaccugguggcccccagaggcuacuucaagaugagaaccggcaagagcagcaucaugagaagcgacgcccccaucgacaccugcuggagcgagugcaucacccccaacggcagcauccccaacgacaagcccuuccagaacgugaacaaggugaccuacggcaagugccccaaguacaucaagcagaacacccugaagcuggccaccggcaugagaaacgugcccgagaagcagaucagaggcaucuucggcgccaucgccggcuucaucgagaacggcugggagggcaugguggacggcugguacggcuucagauaccagaacagcgagggcaccggccaggccgccgaccugaagagcacccaggccgccaucgaccagaucaacggcaagcugaacagagugaucgagagaaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacgccgagaugaacaagcuguucgagaagaccagaagacagcugagagagaacgccgaggacaugggcggcggcugcuucaagaucuaccacaagugcgacaacgccugcaucggcagcaucagaaacggcaccuacgaccacuacaucuacagagacgaggcccugaacaacagauuccagaucaagggcguggagcugaagagcggcuacaaggacuggauccuguggaucagcuucgccaucagcugcuuccugaucugcguggugcugcugggcuucaucaugugggccugcgagaagggcaacaucagaugcaacaucugcaucuga

SEQ ID NO: 153456 - RNA, 1701 nt, Artificial Sequence
  derived and/or modified sequence opt4 from hemagglutinin__InfluenzaA__ABF60577
augaagaccaucaucgugcugagcuacuucuucugccuggcccugagccaggacuacagcgagagcaacaacagcaccgccacccugugccugggccaccacgccgugcccaacggcaccaucgugaagaccaucaccgacgaccagaucgaggugaccaacgccaccgagcuggugcagagcagcagcaccggcaagaucugcaacaacccccacagaauccuggacggcagagacugcacccugaucgacgcccugcugggcgacccccacugcgacguguuccaggacgagaccugggaccuguacguggagagaagcagcgccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccgccagcggcuucuucagcagacugaacuggcugaccaagagcggcagcaccuaccccgugcugaacgugaccaugcccaacgacgacaacuucgacaagcuguacguguggggcgugcaccaccccagcaccaaccaggagcagaccgaccuguacgugcaggccagcggcagagugaccgugagcaccagaagaagccagcagaccaucauccccaacaucggcagcagacccugggugagaggccagagcggcagaaucagcaucuacuggaccaucgugaagcccggcgacgugcuggugaucaacagcaacggcaaccugaucgcccccagaggcuacuucaagaucagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagagcacccugaagcuggccaccggcaugagaaacgugcccgagaagaagaccagaggccuguucguggccaucgccggcuucaucgagaacggcugggagggcaugaucgacugcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaacuacguggaggacaccaagaucgaccuguggagcuacaacgccgagcugcugguggcccuggagaaccagcacaccaucgaccugaccgacagcgagaugaacaagcuguucgagagaaccagaagacagcugagagagaacgccgaggacaugggcagcggcugcuucaagaucuaccacaagugcgacaacgccugcaucgagagcaucagaaacggcaccuacgaccacgacaucuacagagacgaggcccugaacaacagauuccagaucaagggcguggagcugaagagcggcuacaaggacuggauccuguggaucagcuucgccaccagcugcuuccugcugugcguggugcugggcggcuucaucaugugggccugccagagaggcaacaucagaugcaacaucugcaucuga

SEQ ID NO: 153457 - RNA, 1701 nt, Artificial Sequence
  derived and/or modified sequence opt4 from hemagglutinin__InfluenzaA__ABF60578
augaagaccaucaucgugcugagcugcuucuucugccuggccuucagccaggaccugagcgagaacaacaacaacaccgccacccugugccugggccaccacgccgugcccaacggcaccaucgugaagaccaucaccgacgaccagaucgaggugaccaacgccaccgagcuggugcagagcagcagcaccggcaagaucugcaacaacccccacagaauccuggacggcagagacugcacccugaucgacgcccugcugggcgacccccacugcgacguguuccaggacgagaccugggaccuguacguggagagaagcaagagcuucagcaacugcuaccccuacgacgugcccgacuacgccagccugagaagccugguggccagcagcggcacccuggaguucaucaccgaggccuucaccuggaccggcgugacccagaacggcggcagcggcgccugcaagagaggccccggcaacggcuucuucagcagacugaacuggcugaccaagagcggcagcgccuaccccgugcugaacgugaccaugcccaacaacgacaacuucgacaagcuguacguguggggcgugcaccaccccagcaccaaccaggagcagaccaaccuguacgugcaggccagcggcagagugaccgugagcaccagaagaagccagcagaccaucauccccaacaucggcagcagacccugggugagaggccagagcagaagaaucagcaucuacuggaccaucgugaagcccggcgacauccuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacaucaagcagagcacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgacgugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacaucuacagagacgaggcccugaacaacagauuccagaucaagggcugcggcgugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 153458 - RNA, 1701 nt, Artificial Sequence
  derived and/or modified sequence opt4 from hemagglutinin__InfluenzaA__ABF60579
augaagacccugaucgcccugagcuacaucuucugccuggugcugggccaggaccugcccggcaacggcaacagcaccgccacccugugccugggccaccacgccgugcccaacggcacccuggugaagaccaucaccgacgaccagaucgaggugaccaacgccaccgagcuggugcagaacuucagcauggacaagaucugcaacaacccccacagaauccuggacggcgccaacugcacccugaucgacgcccugcugggcgacccccacugcgacgacuuccagaacgagaagugggaccuguucguggagagaagcaaggccuucagcaacugcuaccccuacgacgugcccgacuacaccagccugagaagccugaucgccagcagcggcacccuggaguucaucaacgaggacuucaacuggaccggcgugacccagaacggcggcagcaacgccugcaagagaggccccgacagcagcuucuucagcagacugaacuggcuguacaagagcggcaacaccuaccccaugcugaacgugaccaugcccaacagcgacaacuucgacaagcuguacaucuggggcgugcaccaccccagcaccgccagagagcagaccaaccuguacgugcaggccagcggcaaggugaccgugagcaccaagagaagccagcagaccaucauccccaacaucggcagcagacccugggugagaggccugagcagcagaaucagcaucuacuggaccaucgugaagcccggcgacauccuggugaucaacagcaacggcaaccugaucgcccccagaggcuacuucaagaugcacaccggcagaagcagcaucaugagaagcgacgcccccaucgacaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcggcguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacaacgaguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153459 - RNA, 1701 nt, Artificial Sequence
  derived and/or modified sequence opt4 from hemagglutinin__InfluenzaA__ABF60580
augaagaccaucaucgcccugagcuacaucuucugccuggccuucgcccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacaacccccacagaauccuggacggcaucaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagaacggcggcagcagcgccugcaagagaggccccgacaacggcuucuucagcagacugaacuggcuguacaagagcggcagcaccuaccccgugcagaacgugaccaugcccaacaacgacaacagcgacaagcuguacaucuggggcgugcaccaccccagcaccgacaaggagcagaccgaccuguacgugcaggccagcggcaaggugaccgugagcaccaagagaauccagcagaccgugauccccaacgugggcagcagacccugggugagaggccugagcagcagagugagcaucuacuggaccaucgugaagcccggcgacgugcuggugaucaacagcaacggcaaccugaucgcccccagaggcuacuacaagaugagaaccggcaagagcagcaucaugagaagcgacgcccccaucggcaccugcagcagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgaggugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153460 - RNA, 1701 nt, Artificial Sequence
  derived and/or modified sequence opt4 from hemagglutinin__InfluenzaA__ABF60581
augaagaccaucaucgugcugagcuacuucuucugccuggcccugagccaggacuacagcgagagcaacaacagcaccgccacccugugccugggccaccacgccgugcccaacggcaccaucgugaagaccaucaccgacgaccagaucgaggugaccaacgccaccgagcuggugcagagcagcagcaccggcaagaucugcaacaacccccacagaauccuggacggcagagacugcacccugaucgacgcccugcugggcgacccccacugcgacguguuccaggacgagaccugggaccuguacguggagagaagcagcgccuucagcaacugcuaccccuacgacgugcccgacuacgacagccugagaagccugguggccagcagcggcacccuggaguucaucaccgagggcuucaccuggaccggcgugacccagaacggcggcagcaacgccugcaagagaggccccgccagcggcuucuucagcagacugaacuggcugaccaagagcggcagcaccuaccccgugcugaacgugaccaugcccaacaacgacaacuucgacaagcuguacguguggggcgugcaccaccccagcaccaaccaggagcagaccaaccuguacgugcaggccagcggcagagugaccgugagcaccagaagaagccagcagaccaucauccccaacaucggcagcagacccugggugagaggccagagcggcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaugcccuuccagaacgugaacaagaucaccuacggcgccugccccaaguacgugaagcagggcacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcgacaacgccgagcugcugguggcccuggagaaccagcacaccaucgaccugaccgacagcgagaugaacaagcuguucgagaagaccagaagacagcugagagagaacgccgaggugaugggcaacggcugcuucaagaucuaccacaagugcgacaacgccugcaucgagagcaucagaaacggcaccuacgaccacgacaucuacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 153461 - RNA, 1701 nt, Artificial Sequence; identical to SEQ ID NO: 153260
  derived and/or modified sequence opt4 from hemagglutinin__InfluenzaA__ABF82651

SEQ ID NO: 153462 - RNA, 1698 nt, Artificial Sequence; identical to SEQ ID NO: 153320
  derived and/or modified sequence opt4 from hemagglutinin__InfluenzaA__ABF82662

SEQ ID NO: 153463 - RNA, 1698 nt, Artificial Sequence
  derived and/or modified sequence opt4 from hemagglutinin__InfluenzaA__ABF82673
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaagggcagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153464 - RNA, 1698 nt, Artificial Sequence; identical to SEQ ID NO: 153361
  derived and/or modified sequence opt4 from hemagglutinin__InfluenzaA__ABF82684

SEQ ID NO: 153465 - RNA, 1701 nt, Artificial Sequence; identical to SEQ ID NO: 153327
  derived and/or modified sequence opt4 from hemagglutinin__InfluenzaA__ABF82695

SEQ ID NO: 153466 - RNA, 1701 nt, Artificial Sequence; identical to SEQ ID NO: 153303
  derived and/or modified sequence opt4 from hemagglutinin__InfluenzaA__ABF82706

SEQ ID NO: 153467 - RNA, 1698 nt, Artificial Sequence; identical to SEQ ID NO: 152819
  derived and/or modified sequence opt4 from hemagglutinin__InfluenzaA__ABF82819

SEQ ID NO: 153468 - RNA, 1698 nt, Artificial Sequence; identical to SEQ ID NO: 153320
  derived and/or modified sequence opt4 from hemagglutinin__InfluenzaA__ABF82830

SEQ ID NO: 153469 - RNA, 1698 nt, Artificial Sequence; identical to SEQ ID NO: 153320
  derived and/or modified sequence opt4 from hemagglutinin__InfluenzaA__ABF82841

SEQ ID NO: 153470 - RNA, 1698 nt, Artificial Sequence; identical to SEQ ID NO: 153320
  derived and/or modified sequence opt4 from hemagglutinin__InfluenzaA__ABF82852

SEQ ID NO: 153471 - RNA, 1698 nt, Artificial Sequence
  derived and/or modified sequence opt4 from hemagglutinin__InfluenzaA__ABF82863
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcauguucuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153472 - RNA, 1698 nt, Artificial Sequence
  derived and/or modified sequence opt4 from hemagglutinin__InfluenzaA__ABF82874
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaucaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153473 - RNA, 1698 nt, Artificial Sequence; identical to SEQ ID NO: 153320
  derived and/or modified sequence opt4 from hemagglutinin__InfluenzaA__ABF82885

SEQ ID NO: 153474 - RNA, 1698 nt, Artificial Sequence; identical to SEQ ID NO: 153320
  derived and/or modified sequence opt4 from hemagglutinin__InfluenzaA__ABF82896

SEQ ID NO: 153475 - RNA, 1698 nt, Artificial Sequence; identical to SEQ ID NO: 153320
  derived and/or modified sequence opt4 from hemagglutinin__InfluenzaA__ABF82907

SEQ ID NO: 153476 - RNA, 1698 nt, Artificial Sequence; identical to SEQ ID NO: 153364
  derived and/or modified sequence opt4 from hemagglutinin__InfluenzaA__ABF82929

SEQ ID NO: 153477 - RNA, 1698 nt, Artificial Sequence; identical to SEQ ID NO: 153320
  derived and/or modified sequence opt4 from hemagglutinin__InfluenzaA__ABF82940

SEQ ID NO: 153478 - RNA, 1701 nt, Artificial Sequence
  derived and/or modified sequence opt4 from hemagglutinin__InfluenzaA__ABF83447
augaagaccaucaucgcccugagcuacaucuucugccuggcccugggccaggaccugcccggcaacgacaacaacaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcggcgugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 153479 - RNA, 1644 nt, Artificial Sequence
  derived and/or modified sequence opt4 from hemagglutinin__InfluenzaA__ABG20468
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcgagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaagaacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugcgagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 153480 - RNA, 1707 nt, Artificial Sequence
  derived and/or modified sequence opt4 from hemagglutinin__InfluenzaA__ABG20472
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaaggcccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 153481 - RNA, 1707 nt, Artificial Sequence
  derived and/or modified sequence opt4 from hemagglutinin__InfluenzaA__ABG20478
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 153482 - RNA, 1701 nt, Artificial Sequence; identical to SEQ ID NO: 153303
  derived and/or modified sequence opt4 from hemagglutinin__InfluenzaA__ABG26758

SEQ ID NO: 153483 - RNA, 1701 nt, Artificial Sequence
  derived and/or modified sequence opt4 from hemagglutinin__InfluenzaA__ABG26769
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucagaaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153484 - RNA, 1701 nt, Artificial Sequence; identical to SEQ ID NO: 153431
  derived and/or modified sequence opt4 from hemagglutinin__InfluenzaA__ABG26780

SEQ ID NO: 153485 - RNA, 1701 nt, Artificial Sequence
  derived and/or modified sequence opt4 from hemagglutinin__InfluenzaA__ABG26791
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugaaggagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153486 - RNA, 1701 nt, Artificial Sequence
  derived and/or modified sequence opt4 from hemagglutinin__InfluenzaA__ABG26802
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacgagagcgagagcaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcggcugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgacaugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153487 - RNA, 1701 nt, Artificial Sequence; identical to SEQ ID NO: 153435
  derived and/or modified sequence opt4 from hemagglutinin__InfluenzaA__ABG26813

SEQ ID NO: 153488 - RNA, 1701 nt, Artificial Sequence
  derived and/or modified sequence opt4 from hemagglutinin__InfluenzaA__ABG26824
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcaagaucugcaucuga

SEQ ID NO: 153489 - RNA, 1701 nt, Artificial Sequence; identical to SEQ ID NO: 153441
  derived and/or modified sequence opt4 from hemagglutinin__InfluenzaA__ABG26835

SEQ ID NO: 153490 - RNA, 1701 nt, Artificial Sequence
  derived and/or modified sequence opt4 from hemagglutinin__InfluenzaA__ABG26890
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153491 - RNA, 1701 nt, Artificial Sequence
  derived and/or modified sequence opt4 from hemagglutinin__InfluenzaA__ABG26901
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacagcugcaagagaggcagcgugaacagcuucuucagcagacugaacuggcugcacaagagcgaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153492 - RNA, 1701 nt, Artificial Sequence
  derived and/or modified sequence opt4 from hemagglutinin__InfluenzaA__ABG26912
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucagcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153493 - RNA, 1698 nt, Artificial Sequence
  derived and/or modified sequence opt4 from hemagglutinin__InfluenzaA__ABG26945
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccagcggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153494 - RNA, 1701 nt, Artificial Sequence
  derived and/or modified sequence opt4 from hemagglutinin__InfluenzaA__ABG26956
augaagaccaucaucgcccugagcuacauccugugccugguguucgcccagaagcugcccggcaacgacaacagaaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcaagcugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153495 - RNA, 1698 nt, Artificial Sequence
  derived and/or modified sequence opt4 from hemagglutinin__InfluenzaA__ABG37120
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcgagagcagcuucuacagaaaccugcuguggcugaccggcaagaacggccuguaccccaaccugagcaugagcuacgugaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153496 - RNA, 1701 nt, Artificial Sequence
  derived and/or modified sequence opt4 from hemagglutinin__InfluenzaA__ABG37131
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacggcccccaccagauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagagcuucaacuggaccggcguggcccagaacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcagagcagcggcagagugaccgugagcaccaagagaagccagcagaccgugacccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagaggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153497 - RNA, 1701 nt, Artificial Sequence; identical to SEQ ID NO: 153303
  derived and/or modified sequence opt4 from hemagglutinin__InfluenzaA__ABG37142

SEQ ID NO: 153498 - RNA, 1701 nt, Artificial Sequence
  derived and/or modified sequence opt4 from hemagglutinin__InfluenzaA__ABG37164
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacgacuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153499 - RNA, 1701 nt, Artificial Sequence
  derived and/or modified sequence opt4 from hemagglutinin__InfluenzaA__ABG37175
augaagaccaucaucgcccugagcuacauccugugccagguguucgccaagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153500 - RNA, 1701 nt, Artificial Sequence
  derived and/or modified sequence opt4 from hemagglutinin__InfluenzaA__ABG37186
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagagugaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacaaggacgaggcccugaacaacagauuccagaucaagggcguggugcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153501 - RNA, 1701 nt, Artificial Sequence
  derived and/or modified sequence opt4 from hemagglutinin__InfluenzaA__ABG37197
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaacggcguggcccaggacggcaagagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153502 - RNA, 1701 nt, Artificial Sequence
  derived and/or modified sequence opt4 from hemagglutinin__InfluenzaA__ABG37208
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacgagaagugggaccuguucguggagagaagcaaggccuucagcaacugcuaccccuacgacgugcccgacuacgccagccugagaagccugguggccagcagcggcacccuggaguucaucaacgagggcuucaacuggaccggcgugacccagagcggcggcagcuacgccugcaagagaggcagcgugaacagcuucuucagcagacugaacuggcuguacaagagcgagagcaaguaccccgcccugaacgugaccaugcccaacaacggcaaguucgacaagcuguacaucuggggcgugcaccaccccagcaccgacaaggagcagaccaaccuguacgugagagccagcggcagagugaccgugagcaccaagagaagccagcagaccgugauccccaacaucggccccagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaccugcagcagcggcugcaucacccccaacggcagcauccccaacgacaagcccuuccagaacgugaacaagaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgacaugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153503 - RNA, 1701 nt, Artificial Sequence
  derived and/or modified sequence opt4 from hemagglutinin__InfluenzaA__ABG37230
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcaccagagcaaguacaaguaccccgagcugaacgugaccaugcccaacaacggcaaguucgacaagcuguacaucuggggcgugcaccaccccagcaccgacagcgaccagaccagccuguacgccagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153504 - RNA, 1701 nt, Artificial Sequence
  derived and/or modified sequence opt4 from hemagglutinin__InfluenzaA__ABG37241
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153505 - RNA, 1701 nt, Artificial Sequence
  derived and/or modified sequence opt4 from hemagglutinin__InfluenzaA__ABG37252
augaagaccaucaucgcccugagcuacauccugugccugguguucgcccagaagcugaccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153506 - RNA, 1701 nt, Artificial Sequence
  derived and/or modified sequence opt4 from hemagglutinin__InfluenzaA__ABG37263
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153507 - RNA, 1701 nt, Artificial Sequence
  derived and/or modified sequence opt4 from hemagglutinin__InfluenzaA__ABG37274
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaucagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucagcagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153508 - RNA, 1701 nt, Artificial Sequence
  derived and/or modified sequence opt4 from hemagglutinin__InfluenzaA__ABG37285
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggacuacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcuucgugcugcugggcuucaucaugugggccugccagaagggcaacaucagaugcaacaucugcaucuga

SEQ ID NO: 153509 - RNA, 1701 nt, Artificial Sequence
  derived and/or modified sequence opt4 from hemagglutinin__InfluenzaA__ABG37296
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153510 - RNA, 1701 nt, Artificial Sequence; identical to SEQ ID NO: 153504
  derived and/or modified sequence opt4 from hemagglutinin__InfluenzaA__ABG37307

SEQ ID NO: 153511 - RNA, 1701 nt, Artificial Sequence; identical to SEQ ID NO: 153509
  derived and/or modified sequence opt4 from hemagglutinin__InfluenzaA__ABG37318

SEQ ID NO: 153512 - RNA, 1701 nt, Artificial Sequence
  derived and/or modified sequence opt4 from hemagglutinin__InfluenzaA__ABG37329
augaagaccaucaucgcccugagcuacauccugugccugguguucgcccagaagcugcccgagaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153513 - RNA, 1701 nt, Artificial Sequence
  derived and/or modified sequence opt4 from hemagglutinin__InfluenzaA__ABG37340
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcuuccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153514 - RNA, 1701 nt, Artificial Sequence
  derived and/or modified sequence opt4 from hemagglutinin__InfluenzaA__ABG37351
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucgacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153515 - RNA, 1698 nt, Artificial Sequence
  derived and/or modified sequence opt4 from hemagglutinin__InfluenzaA__ABG37362
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153516 - RNA, 1698 nt, Artificial Sequence; identical to SEQ ID NO: 153320
  derived and/or modified sequence opt4 from hemagglutinin__InfluenzaA__ABG37384

SEQ ID NO: 153517 - RNA, 1698 nt, Artificial Sequence; identical to SEQ ID NO: 153390
  derived and/or modified sequence opt4 from hemagglutinin__InfluenzaA__ABG37395

SEQ ID NO: 153518 - RNA, 1701 nt, Artificial Sequence; identical to SEQ ID NO: 153297
  derived and/or modified sequence opt4 from hemagglutinin__InfluenzaA__ABG37406

SEQ ID NO: 153519 - RNA, 1701 nt, Artificial Sequence
  derived and/or modified sequence opt4 from hemagglutinin__InfluenzaA__ABG37428
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaagagccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153520 - RNA, 1701 nt, Artificial Sequence; identical to SEQ ID NO: 153082
  derived and/or modified sequence opt4 from hemagglutinin__InfluenzaA__ABG37439

SEQ ID NO: 153521 - RNA, 1701 nt, Artificial Sequence; identical to SEQ ID NO: 153160
  derived and/or modified sequence opt4 from hemagglutinin__InfluenzaA__ABG37461

SEQ ID NO: 153522 - RNA, 1701 nt, Artificial Sequence
  derived and/or modified sequence opt4 from hemagglutinin__InfluenzaA__ABG37472
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccaggugcuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153523 - RNA, 1701 nt, Artificial Sequence; identical to SEQ ID NO: 153082
  derived and/or modified sequence opt4 from hemagglutinin__InfluenzaA__ABG37483

SEQ ID NO: 153524 - RNA, 1701 nt, Artificial Sequence; identical to SEQ ID NO: 153160
  derived and/or modified sequence opt4 from hemagglutinin__InfluenzaA__ABG37494

SEQ ID NO: 153525 - RNA, 1701 nt, Artificial Sequence
  derived and/or modified sequence opt4 from hemagglutinin__InfluenzaA__ABG37505
augaagaccaucaucgcccugagcuacauccugugccugguguucgcccagaagcugcccggcaacgacaacagcauggccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggccugugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153526 - RNA, 1701 nt, Artificial Sequence; identical to SEQ ID NO: 153036
  derived and/or modified sequence opt4 from hemagglutinin__InfluenzaA__ABG37516

SEQ ID NO: 153527 - RNA, 1701 nt, Artificial Sequence; identical to SEQ ID NO: 153036
  derived and/or modified sequence opt4 from hemagglutinin__InfluenzaA__ABG37527

SEQ ID NO: 153528 - RNA, 1701 nt, Artificial Sequence; identical to SEQ ID NO: 153036
  derived and/or modified sequence opt4 from hemagglutinin__InfluenzaA__ABG37538

SEQ ID NO: 153529 - RNA, 1701 nt, Artificial Sequence; identical to SEQ ID NO: 153036
  derived and/or modified sequence opt4 from hemagglutinin__InfluenzaA__ABG37549

SEQ ID NO: 153530 - RNA, 1701 nt, Artificial Sequence; identical to SEQ ID NO: 153036
  derived and/or modified sequence opt4 from hemagglutinin__InfluenzaA__ABG37560

SEQ ID NO: 153531 - RNA, 1701 nt, Artificial Sequence; identical to SEQ ID NO: 153036
  derived and/or modified sequence opt4 from hemagglutinin__InfluenzaA__ABG37571

SEQ ID NO: 153532 - RNA, 1701 nt, Artificial Sequence
  derived and/or modified sequence opt4 from hemagglutinin__InfluenzaA__ABG37582
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaucagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153533 - RNA, 1701 nt, Artificial Sequence; identical to SEQ ID NO: 153036
  derived and/or modified sequence opt4 from hemagglutinin__InfluenzaA__ABG37604

SEQ ID NO: 153534 - RNA, 1701 nt, Artificial Sequence; identical to SEQ ID NO: 153036
  derived and/or modified sequence opt4 from hemagglutinin__InfluenzaA__ABG37615

SEQ ID NO: 153535 - RNA, 1698 nt, Artificial Sequence; identical to SEQ ID NO: 153262
  derived and/or modified sequence opt4 from hemagglutinin__InfluenzaA__ABG47807

SEQ ID NO: 153536 - RNA, 1698 nt, Artificial Sequence; identical to SEQ ID NO: 153261
  derived and/or modified sequence opt4 from hemagglutinin__InfluenzaA__ABG47818

SEQ ID NO: 153537 - RNA, 1701 nt, Artificial Sequence
  derived and/or modified sequence opt4 from hemagglutinin__InfluenzaA__ABG47829
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucaccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153538 - RNA, 1701 nt, Artificial Sequence
  derived and/or modified sequence opt4 from hemagglutinin__InfluenzaA__ABG47840
augaaggugaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugagcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153539 - RNA, 1701 nt, Artificial Sequence
  derived and/or modified sequence opt4 from hemagglutinin__InfluenzaA__ABG47851
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 153540 - RNA, 1701 nt, Artificial Sequence
  derived and/or modified sequence opt4 from hemagglutinin__InfluenzaA__ABG47862
augagaaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugaucgccagcagcggcacccuggaguucaccaacgagggcuucaacuggaccggcguggcccaggacggcaccagcuacgccugcaagagaggcagcgugaagagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153541 - RNA, 1701 nt, Artificial Sequence; identical to SEQ ID NO: 153504
  derived and/or modified sequence opt4 from hemagglutinin__InfluenzaA__ABG47873

SEQ ID NO: 153542 - RNA, 1701 nt, Artificial Sequence; identical to SEQ ID NO: 153509
  derived and/or modified sequence opt4 from hemagglutinin__InfluenzaA__ABG47895

SEQ ID NO: 153543 - RNA, 1701 nt, Artificial Sequence; identical to SEQ ID NO: 153504
  derived and/or modified sequence opt4 from hemagglutinin__InfluenzaA__ABG47906

SEQ ID NO: 153544 - RNA, 1701 nt, Artificial Sequence
  derived and/or modified sequence opt4 from hemagglutinin__InfluenzaA__ABG47917
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153545 - RNA, 1701 nt, Artificial Sequence; identical to SEQ ID NO: 153544
  derived and/or modified sequence opt4 from hemagglutinin__InfluenzaA__ABG47928

SEQ ID NO: 153546 - RNA, 1701 nt, Artificial Sequence
  derived and/or modified sequence opt4 from hemagglutinin__InfluenzaA__ABG47939
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagccccuacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153547 - RNA, 1701 nt, Artificial Sequence
  derived and/or modified sequence opt4 from hemagglutinin__InfluenzaA__ABG47950
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagccugggcacccuggaguucaucaacgaggacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgccagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaccggcaagagcagcaucaugagaagcgacgcccccaucggcaacugcagcagcgagugcaucacccccaacggcaacauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggcuuccugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153548 - RNA, 1701 nt, Artificial Sequence
  derived and/or modified sequence opt4 from hemagglutinin__InfluenzaA__ABG47961
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcggcgugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaugagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153549 - RNA, 1701 nt, Artificial Sequence; identical to SEQ ID NO: 153544
  derived and/or modified sequence opt4 from hemagglutinin__InfluenzaA__ABG47972

SEQ ID NO: 153550 - RNA, 1701 nt, Artificial Sequence; identical to SEQ ID NO: 153544
  derived and/or modified sequence opt4 from hemagglutinin__InfluenzaA__ABG47983

SEQ ID NO: 153551 - RNA, 1701 nt, Artificial Sequence; identical to SEQ ID NO: 153544
  derived and/or modified sequence opt4 from hemagglutinin__InfluenzaA__ABG47994

SEQ ID NO: 153552 - RNA, 1701 nt, Artificial Sequence
  derived and/or modified sequence opt4 from hemagglutinin__InfluenzaA__ABG48005
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153553 - RNA, 1701 nt, Artificial Sequence; identical to SEQ ID NO: 153544
  derived and/or modified sequence opt4 from hemagglutinin__InfluenzaA__ABG48016

SEQ ID NO: 153554 - RNA, 1701 nt, Artificial Sequence; identical to SEQ ID NO: 153544
  derived and/or modified sequence opt4 from hemagglutinin__InfluenzaA__ABG48027

SEQ ID NO: 153555 - RNA, 1698 nt, Artificial Sequence
  derived and/or modified sequence opt4 from hemagglutinin__InfluenzaA__ABG48049
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcacccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153556 - RNA, 1701 nt, Artificial Sequence; identical to SEQ ID NO: 153170
  derived and/or modified sequence opt4 from hemagglutinin__InfluenzaA__ABG48060

SEQ ID NO: 153557 - RNA, 1701 nt, Artificial Sequence; identical to SEQ ID NO: 153170
  derived and/or modified sequence opt4 from hemagglutinin__InfluenzaA__ABG48071

SEQ ID NO: 153558 - RNA, 1701 nt, Artificial Sequence
  derived and/or modified sequence opt4 from hemagglutinin__InfluenzaA__ABG48082
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcugcaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153559 - RNA, 1701 nt, Artificial Sequence
  derived and/or modified sequence opt4 from hemagglutinin__InfluenzaA__ABG48104
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcagagccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153560 - RNA, 1701 nt, Artificial Sequence; identical to SEQ ID NO: 153160
  derived and/or modified sequence opt4 from hemagglutinin__InfluenzaA__ABG48115

SEQ ID NO: 153561 - RNA, 1701 nt, Artificial Sequence; identical to SEQ ID NO: 153167
  derived and/or modified sequence opt4 from hemagglutinin__InfluenzaA__ABG48126

SEQ ID NO: 153562 - RNA, 1701 nt, Artificial Sequence; identical to SEQ ID NO: 153082
  derived and/or modified sequence opt4 from hemagglutinin__InfluenzaA__ABG48148

SEQ ID NO: 153563 - RNA, 1701 nt, Artificial Sequence; identical to SEQ ID NO: 153082
  derived and/or modified sequence opt4 from hemagglutinin__InfluenzaA__ABG48159

SEQ ID NO: 153564 - RNA, 1701 nt, Artificial Sequence
  derived and/or modified sequence opt4 from hemagglutinin__InfluenzaA__ABG48170
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacuucgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153565 - RNA, 1701 nt, Artificial Sequence
  derived and/or modified sequence opt4 from hemagglutinin__InfluenzaA__ABG48181
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcuacgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153566 - RNA, 1701 nt, Artificial Sequence; identical to SEQ ID NO: 153082
  derived and/or modified sequence opt4 from hemagglutinin__InfluenzaA__ABG48192

SEQ ID NO: 153567 - RNA, 1701 nt, Artificial Sequence
  derived and/or modified sequence opt4 from hemagglutinin__InfluenzaA__ABG48203
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacgugugcaucuga

SEQ ID NO: 153568 - RNA, 1701 nt, Artificial Sequence; identical to SEQ ID NO: 153036
  derived and/or modified sequence opt4 from hemagglutinin__InfluenzaA__ABG48214

SEQ ID NO: 153569 - RNA, 1701 nt, Artificial Sequence; identical to SEQ ID NO: 153036
  derived and/or modified sequence opt4 from hemagglutinin__InfluenzaA__ABG48236

SEQ ID NO: 153570 - RNA, 1701 nt, Artificial Sequence
  derived and/or modified sequence opt4 from hemagglutinin__InfluenzaA__ABG48247
augaagaccaucaucgcccugagcuacauccugugccugguguucgcccagaagcugcccggcaacgacaacaacaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153571 - RNA, 1701 nt, Artificial Sequence
  derived and/or modified sequence opt4 from hemagglutinin__InfluenzaA__ABG48269
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagccccaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaagagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugcccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153572 - RNA, 1701 nt, Artificial Sequence
  derived and/or modified sequence opt4 from hemagglutinin__InfluenzaA__ABG48291
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagagcgaguacaaguaccccgcccugaacgugagcaugcccaacaacggcaaguucaacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcuucgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153573 - RNA, 1701 nt, Artificial Sequence
  derived and/or modified sequence opt4 from hemagglutinin__InfluenzaA__ABG48335
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153574 - RNA, 1701 nt, Artificial Sequence
  derived and/or modified sequence opt4 from hemagglutinin__InfluenzaA__ABG48346
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaaacaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacagacccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153575 - RNA, 1701 nt, Artificial Sequence; identical to SEQ ID NO: 153573
  derived and/or modified sequence opt4 from hemagglutinin__InfluenzaA__ABG48357

SEQ ID NO: 153576 - RNA, 1701 nt, Artificial Sequence
  derived and/or modified sequence opt4 from hemagglutinin__InfluenzaA__ABG48368
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagguguaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153577 - RNA, 1701 nt, Artificial Sequence; identical to SEQ ID NO: 153427
  derived and/or modified sequence opt4 from hemagglutinin__InfluenzaA__ABG67135

SEQ ID NO: 153578 - RNA, 1701 nt, Artificial Sequence; identical to SEQ ID NO: 153303
  derived and/or modified sequence opt4 from hemagglutinin__InfluenzaA__ABG67146

SEQ ID NO: 153579 - RNA, 1701 nt, Artificial Sequence
  derived and/or modified sequence opt4 from hemagglutinin__InfluenzaA__ABG67157
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcaacagcccccacagaaucaucgacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagcugagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153580 - RNA, 1701 nt, Artificial Sequence; identical to SEQ ID NO: 153504
  derived and/or modified sequence opt4 from hemagglutinin__InfluenzaA__ABG67168

SEQ ID NO: 153581 - RNA, 1701 nt, Artificial Sequence; identical to SEQ ID NO: 153504
  derived and/or modified sequence opt4 from hemagglutinin__InfluenzaA__ABG67179

SEQ ID NO: 153582 - RNA, 1701 nt, Artificial Sequence
  derived and/or modified sequence opt4 from hemagglutinin__InfluenzaA__ABG67190
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcuuccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153583 - RNA, 1701 nt, Artificial Sequence
  derived and/or modified sequence opt4 from hemagglutinin__InfluenzaA__ABG67212
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacagauaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153584 - RNA, 1701 nt, Artificial Sequence; identical to SEQ ID NO: 153544
  derived and/or modified sequence opt4 from hemagglutinin__InfluenzaA__ABG67223

SEQ ID NO: 153585 - RNA, 1701 nt, Artificial Sequence
  derived and/or modified sequence opt4 from hemagglutinin__InfluenzaA__ABG67234
augaagaccaucaucgcccugagcuacauccugugccugguguucgcccagaagcugcccggcgacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucguggagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153586 - RNA, 1701 nt, Artificial Sequence
  derived and/or modified sequence opt4 from hemagglutinin__InfluenzaA__ABG67245
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucgacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153587 - RNA, 1698 nt, Artificial Sequence; identical to SEQ ID NO: 153262
  derived and/or modified sequence opt4 from hemagglutinin__InfluenzaA__ABG67477

SEQ ID NO: 153588 - RNA, 1698 nt, Artificial Sequence; identical to SEQ ID NO: 153320
  derived and/or modified sequence opt4 from hemagglutinin__InfluenzaA__ABG67491

SEQ ID NO: 153589 - RNA, 1701 nt, Artificial Sequence
  derived and/or modified sequence opt4 from hemagglutinin__InfluenzaA__ABG67502
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugagcgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153590 - RNA, 1701 nt, Artificial Sequence
  derived and/or modified sequence opt4 from hemagglutinin__InfluenzaA__ABG67524
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcagagccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccgugaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153591 - RNA, 1701 nt, Artificial Sequence; identical to SEQ ID NO: 153082
  derived and/or modified sequence opt4 from hemagglutinin__InfluenzaA__ABG67535

SEQ ID NO: 153592 - RNA, 1701 nt, Artificial Sequence; identical to SEQ ID NO: 153036
  derived and/or modified sequence opt4 from hemagglutinin__InfluenzaA__ABG67546

SEQ ID NO: 153593 - RNA, 1701 nt, Artificial Sequence
  derived and/or modified sequence opt4 from hemagglutinin__InfluenzaA__ABG67557
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccaccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153594 - RNA, 1701 nt, Artificial Sequence; identical to SEQ ID NO: 153036
  derived and/or modified sequence opt4 from hemagglutinin__InfluenzaA__ABG67568

SEQ ID NO: 153595 - RNA, 1701 nt, Artificial Sequence; identical to SEQ ID NO: 153036
  derived and/or modified sequence opt4 from hemagglutinin__InfluenzaA__ABG67579

SEQ ID NO: 153596 - RNA, 1701 nt, Artificial Sequence; identical to SEQ ID NO: 153036
  derived and/or modified sequence opt4 from hemagglutinin__InfluenzaA__ABG67590

SEQ ID NO: 153597 - RNA, 1701 nt, Artificial Sequence; identical to SEQ ID NO: 153036
  derived and/or modified sequence opt4 from hemagglutinin__InfluenzaA__ABG67601

SEQ ID NO: 153598 - RNA, 1701 nt, Artificial Sequence; identical to SEQ ID NO: 153036
  derived and/or modified sequence opt4 from hemagglutinin__InfluenzaA__ABG67612

SEQ ID NO: 153599 - RNA, 1701 nt, Artificial Sequence; identical to SEQ ID NO: 153036
  derived and/or modified sequence opt4 from hemagglutinin__InfluenzaA__ABG67623

SEQ ID NO: 153600 - RNA, 1701 nt, Artificial Sequence
  derived and/or modified sequence opt4 from hemagglutinin__InfluenzaA__ABG67634
augaagaccaucaucgcccugagcuacauccugugccugguguucgcccagaagcugcccggcaacgacaacaacaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcaagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153601 - RNA, 1701 nt, Artificial Sequence; identical to SEQ ID NO: 153036
  derived and/or modified sequence opt4 from hemagglutinin__InfluenzaA__ABG67645

SEQ ID NO: 153602 - RNA, 1701 nt, Artificial Sequence
  derived and/or modified sequence opt4 from hemagglutinin__InfluenzaA__ABG67656
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacugggccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagaucgagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153603 - RNA, 1701 nt, Artificial Sequence
  derived and/or modified sequence opt4 from hemagglutinin__InfluenzaA__ABG67667
augaagaccaucaucgcccugagcuacauccugugccagguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaucggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153604 - RNA, 1701 nt, Artificial Sequence
  derived and/or modified sequence opt4 from hemagglutinin__InfluenzaA__ABG79941
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcagcaucugcaucuga

SEQ ID NO: 153605 - RNA, 1701 nt, Artificial Sequence; identical to SEQ ID NO: 153441
  derived and/or modified sequence opt4 from hemagglutinin__InfluenzaA__ABG79952

SEQ ID NO: 153606 - RNA, 1701 nt, Artificial Sequence; identical to SEQ ID NO: 153504
  derived and/or modified sequence opt4 from hemagglutinin__InfluenzaA__ABG79974

SEQ ID NO: 153607 - RNA, 1701 nt, Artificial Sequence; identical to SEQ ID NO: 153504
  derived and/or modified sequence opt4 from hemagglutinin__InfluenzaA__ABG79985

SEQ ID NO: 153608 - RNA, 1701 nt, Artificial Sequence
  derived and/or modified sequence opt4 from hemagglutinin__InfluenzaA__ABG79996
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153609 - RNA, 1701 nt, Artificial Sequence; identical to SEQ ID NO: 153504
  derived and/or modified sequence opt4 from hemagglutinin__InfluenzaA__ABG80007

SEQ ID NO: 153610 - RNA, 1701 nt, Artificial Sequence; identical to SEQ ID NO: 153504
  derived and/or modified sequence opt4 from hemagglutinin__InfluenzaA__ABG80018

SEQ ID NO: 153611 - RNA, 1701 nt, Artificial Sequence; identical to SEQ ID NO: 153509
  derived and/or modified sequence opt4 from hemagglutinin__InfluenzaA__ABG80029

SEQ ID NO: 153612 - RNA, 1701 nt, Artificial Sequence; identical to SEQ ID NO: 153509
  derived and/or modified sequence opt4 from hemagglutinin__InfluenzaA__ABG80040

SEQ ID NO: 153613 - RNA, 1701 nt, Artificial Sequence; identical to SEQ ID NO: 153504
  derived and/or modified sequence opt4 from hemagglutinin__InfluenzaA__ABG80051

SEQ ID NO: 153614 - RNA, 1701 nt, Artificial Sequence
  derived and/or modified sequence opt4 from hemagglutinin__InfluenzaA__ABG80062
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagaccggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153615 - RNA, 1701 nt, Artificial Sequence
  derived and/or modified sequence opt4 from hemagglutinin__InfluenzaA__ABG80073
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgaccccaacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaccugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153616 - RNA, 1701 nt, Artificial Sequence
  derived and/or modified sequence opt4 from hemagglutinin__InfluenzaA__ABG80084
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcggcaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacaucuacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153617 - RNA, 1701 nt, Artificial Sequence
  derived and/or modified sequence opt4 from hemagglutinin__InfluenzaA__ABG80095
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaagguggacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153618 - RNA, 1701 nt, Artificial Sequence; identical to SEQ ID NO: 153544
  derived and/or modified sequence opt4 from hemagglutinin__InfluenzaA__ABG80106

SEQ ID NO: 153619 - RNA, 1701 nt, Artificial Sequence
  derived and/or modified sequence opt4 from hemagglutinin__InfluenzaA__ABG80117
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgugaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153620 - RNA, 1701 nt, Artificial Sequence
  derived and/or modified sequence opt4 from hemagglutinin__InfluenzaA__ABG80128
augaagaccaucaucgcccugagcuacauccugugccugguguucgcccagaagcugcccggcaacgacaacagcaccgccacccugugccugggccaccacgccgugcccaacggcacccuggugaagaccaucaccaacgacagaaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153621 - RNA, 1701 nt, Artificial Sequence
  derived and/or modified sequence opt4 from hemagglutinin__InfluenzaA__ABG80139
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcuacgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153622 - RNA, 1701 nt, Artificial Sequence
  derived and/or modified sequence opt4 from hemagglutinin__InfluenzaA__ABG80150
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcggcaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153623 - RNA, 1701 nt, Artificial Sequence
  derived and/or modified sequence opt4 from hemagglutinin__InfluenzaA__ABG80161
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugcaggccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153624 - RNA, 1698 nt, Artificial Sequence
  derived and/or modified sequence opt4 from hemagglutinin__InfluenzaA__ABG80172
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacaacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153625 - RNA, 1698 nt, Artificial Sequence
  derived and/or modified sequence opt4 from hemagglutinin__InfluenzaA__ABG80183
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcggccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153626 - RNA, 1701 nt, Artificial Sequence
  derived and/or modified sequence opt4 from hemagglutinin__InfluenzaA__ABG80194
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggaguggaaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcaucaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153627 - RNA, 1701 nt, Artificial Sequence
  derived and/or modified sequence opt4 from hemagglutinin__InfluenzaA__ABG80205
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacguggccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucaaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153628 - RNA, 1701 nt, Artificial Sequence
  derived and/or modified sequence opt4 from hemagglutinin__InfluenzaA__ABG80216
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagccccaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153629 - RNA, 1701 nt, Artificial Sequence; identical to SEQ ID NO: 153160
  derived and/or modified sequence opt4 from hemagglutinin__InfluenzaA__ABG80227

SEQ ID NO: 153630 - RNA, 1701 nt, Artificial Sequence; identical to SEQ ID NO: 153036
  derived and/or modified sequence opt4 from hemagglutinin__InfluenzaA__ABG80238

SEQ ID NO: 153631 - RNA, 1701 nt, Artificial Sequence; identical to SEQ ID NO: 153036
  derived and/or modified sequence opt4 from hemagglutinin__InfluenzaA__ABG80249

SEQ ID NO: 153632 - RNA, 1701 nt, Artificial Sequence; identical to SEQ ID NO: 153036
  derived and/or modified sequence opt4 from hemagglutinin__InfluenzaA__ABG80260

SEQ ID NO: 153633 - RNA, 1701 nt, Artificial Sequence
  derived and/or modified sequence opt4 from hemagglutinin__InfluenzaA__ABG80271
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcggcaucugcgacagcccccaccagauccuggacggcgagaacugcacccugauggacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153634 - RNA, 1701 nt, Artificial Sequence; identical to SEQ ID NO: 153111
  derived and/or modified sequence opt4 from hemagglutinin__InfluenzaA__ABG80282

SEQ ID NO: 153635 - RNA, 1701 nt, Artificial Sequence; identical to SEQ ID NO: 152763
  derived and/or modified sequence opt4 from hemagglutinin__InfluenzaA__ABG80293

SEQ ID NO: 153636 - RNA, 1701 nt, Artificial Sequence
  derived and/or modified sequence opt4 from hemagglutinin__InfluenzaA__ABG80304
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucaaccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153637 - RNA, 1701 nt, Artificial Sequence
  derived and/or modified sequence opt4 from hemagglutinin__InfluenzaA__ABG80315
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcugauccagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacaugcugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153638 - RNA, 1701 nt, Artificial Sequence; identical to SEQ ID NO: 152802
  derived and/or modified sequence opt4 from hemagglutinin__InfluenzaA__ABG80326

SEQ ID NO: 153639 - RNA, 1701 nt, Artificial Sequence; identical to SEQ ID NO: 152802
  derived and/or modified sequence opt4 from hemagglutinin__InfluenzaA__ABG80337

SEQ ID NO: 153640 - RNA, 1701 nt, Artificial Sequence
  derived and/or modified sequence opt4 from hemagglutinin__InfluenzaA__ABG80359
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccagcgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccguggaccagaucaacggcaagcugaacagacugaucgagagaaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153641 - RNA, 1701 nt, Artificial Sequence
  derived and/or modified sequence opt4 from hemagglutinin__InfluenzaA__ABG80370
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaagagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153642 - RNA, 1701 nt, Artificial Sequence; identical to SEQ ID NO: 153573
  derived and/or modified sequence opt4 from hemagglutinin__InfluenzaA__ABG80392

SEQ ID NO: 153643 - RNA, 1701 nt, Artificial Sequence; identical to SEQ ID NO: 153573
  derived and/or modified sequence opt4 from hemagglutinin__InfluenzaA__ABG80403

SEQ ID NO: 153644 - RNA, 1701 nt, Artificial Sequence; identical to SEQ ID NO: 153573
  derived and/or modified sequence opt4 from hemagglutinin__InfluenzaA__ABG80414

SEQ ID NO: 153645 - RNA, 1701 nt, Artificial Sequence; identical to SEQ ID NO: 153573
  derived and/or modified sequence opt4 from hemagglutinin__InfluenzaA__ABG80425

SEQ ID NO: 153646 - RNA, 1701 nt, Artificial Sequence; identical to SEQ ID NO: 153303
  derived and/or modified sequence opt4 from hemagglutinin__InfluenzaA__ABG88289

SEQ ID NO: 153647 - RNA, 1701 nt, Artificial Sequence
  derived and/or modified sequence opt4 from hemagglutinin__InfluenzaA__ABG88300
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccgaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153648 - RNA, 1701 nt, Artificial Sequence; identical to SEQ ID NO: 153431
  derived and/or modified sequence opt4 from hemagglutinin__InfluenzaA__ABG88311

SEQ ID NO: 153649 - RNA, 1701 nt, Artificial Sequence
  derived and/or modified sequence opt4 from hemagglutinin__InfluenzaA__ABG88322
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccauccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153650 - RNA, 1701 nt, Artificial Sequence
  derived and/or modified sequence opt4 from hemagglutinin__InfluenzaA__ABG88333
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucagcaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153651 - RNA, 1701 nt, Artificial Sequence
  derived and/or modified sequence opt4 from hemagglutinin__InfluenzaA__ABG88344
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucagcaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153652 - RNA, 1701 nt, Artificial Sequence
  derived and/or modified sequence opt4 from hemagglutinin__InfluenzaA__ABG88355
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcgagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153653 - RNA, 1701 nt, Artificial Sequence
  derived and/or modified sequence opt4 from hemagglutinin__InfluenzaA__ABG88366
augaagaccaucaucgcccugagcuacuuccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153654 - RNA, 1701 nt, Artificial Sequence; identical to SEQ ID NO: 153504
  derived and/or modified sequence opt4 from hemagglutinin__InfluenzaA__ABG88377

SEQ ID NO: 153655 - RNA, 1701 nt, Artificial Sequence; identical to SEQ ID NO: 153504
  derived and/or modified sequence opt4 from hemagglutinin__InfluenzaA__ABG88388

SEQ ID NO: 153656 - RNA, 1701 nt, Artificial Sequence
  derived and/or modified sequence opt4 from hemagglutinin__InfluenzaA__ABG88399
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagagcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153657 - RNA, 1701 nt, Artificial Sequence; identical to SEQ ID NO: 153544
  derived and/or modified sequence opt4 from hemagglutinin__InfluenzaA__ABG88410

SEQ ID NO: 153658 - RNA, 1701 nt, Artificial Sequence; identical to SEQ ID NO: 153544
  derived and/or modified sequence opt4 from hemagglutinin__InfluenzaA__ABG88421

SEQ ID NO: 153659 - RNA, 1701 nt, Artificial Sequence
  derived and/or modified sequence opt4 from hemagglutinin__InfluenzaA__ABG88432
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaugagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153660 - RNA, 1701 nt, Artificial Sequence; identical to SEQ ID NO: 153544
  derived and/or modified sequence opt4 from hemagglutinin__InfluenzaA__ABG88443

SEQ ID NO: 153661 - RNA, 1701 nt, Artificial Sequence
  derived and/or modified sequence opt4 from hemagglutinin__InfluenzaA__ABG88454
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgccaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcggcgugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucggcaagaccaacgacaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153662 - RNA, 1701 nt, Artificial Sequence
  derived and/or modified sequence opt4 from hemagglutinin__InfluenzaA__ABG88465
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153663 - RNA, 1701 nt, Artificial Sequence; identical to SEQ ID NO: 153544
  derived and/or modified sequence opt4 from hemagglutinin__InfluenzaA__ABG88476

SEQ ID NO: 153664 - RNA, 1701 nt, Artificial Sequence; identical to SEQ ID NO: 153544
  derived and/or modified sequence opt4 from hemagglutinin__InfluenzaA__ABG88487

SEQ ID NO: 153665 - RNA, 1701 nt, Artificial Sequence; identical to SEQ ID NO: 153544
  derived and/or modified sequence opt4 from hemagglutinin__InfluenzaA__ABG88498

SEQ ID NO: 153666 - RNA, 1701 nt, Artificial Sequence; identical to SEQ ID NO: 153544
  derived and/or modified sequence opt4 from hemagglutinin__InfluenzaA__ABG88509

SEQ ID NO: 153667 - RNA, 1701 nt, Artificial Sequence
  derived and/or modified sequence opt4 from hemagglutinin__InfluenzaA__ABG88520
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaccaugugggccugccagaagggcaacaucagaugcaacaucugcaucuga

SEQ ID NO: 153668 - RNA, 1701 nt, Artificial Sequence
  derived and/or modified sequence opt4 from hemagglutinin__InfluenzaA__ABG88531
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgugcagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153669 - RNA, 1698 nt, Artificial Sequence; identical to SEQ ID NO: 153555
  derived and/or modified sequence opt4 from hemagglutinin__InfluenzaA__ABG88553

SEQ ID NO: 153670 - RNA, 1701 nt, Artificial Sequence; identical to SEQ ID NO: 153230
  derived and/or modified sequence opt4 from hemagglutinin__InfluenzaA__ABG88564

SEQ ID NO: 153671 - RNA, 1701 nt, Artificial Sequence; identical to SEQ ID NO: 153260
  derived and/or modified sequence opt4 from hemagglutinin__InfluenzaA__ABG88575

SEQ ID NO: 153672 - RNA, 1701 nt, Artificial Sequence; identical to SEQ ID NO: 153170
  derived and/or modified sequence opt4 from hemagglutinin__InfluenzaA__ABG88586

SEQ ID NO: 153673 - RNA, 1701 nt, Artificial Sequence
  derived and/or modified sequence opt4 from hemagglutinin__InfluenzaA__ABG88597
augaagaccaucaucgcccugagcuacauccugugccugguguucgcccagaagcugcccgccaacgacaacagcaccgccacccugugccugggccaccacgccgugcccaacggcacccuggugaagaccaucaccaacgacaacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153674 - RNA, 1701 nt, Artificial Sequence
  derived and/or modified sequence opt4 from hemagglutinin__InfluenzaA__ABG88608
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcagagccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaccagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153675 - RNA, 1701 nt, Artificial Sequence; identical to SEQ ID NO: 153082
  derived and/or modified sequence opt4 from hemagglutinin__InfluenzaA__ABG88619

SEQ ID NO: 153676 - RNA, 1701 nt, Artificial Sequence
  derived and/or modified sequence opt4 from hemagglutinin__InfluenzaA__ABG88630
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccaggugcuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153677 - RNA, 1701 nt, Artificial Sequence
  derived and/or modified sequence opt4 from hemagglutinin__InfluenzaA__ABG88641
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacggcaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaccagcugcuuccugcugugcaucgugcugcugggcuucaucaugugggccugccagaagggcaacaucagaugcaacaucugcaucuga

SEQ ID NO: 153678 - RNA, 1701 nt, Artificial Sequence; identical to SEQ ID NO: 153036
  derived and/or modified sequence opt4 from hemagglutinin__InfluenzaA__ABG88652

SEQ ID NO: 153679 - RNA, 1701 nt, Artificial Sequence; identical to SEQ ID NO: 153036
  derived and/or modified sequence opt4 from hemagglutinin__InfluenzaA__ABG88663

SEQ ID NO: 153680 - RNA, 1701 nt, Artificial Sequence; identical to SEQ ID NO: 153036
  derived and/or modified sequence opt4 from hemagglutinin__InfluenzaA__ABG88674

SEQ ID NO: 153681 - RNA, 1701 nt, Artificial Sequence; identical to SEQ ID NO: 153036
  derived and/or modified sequence opt4 from hemagglutinin__InfluenzaA__ABG88685

SEQ ID NO: 153682 - RNA, 1701 nt, Artificial Sequence; identical to SEQ ID NO: 153036
  derived and/or modified sequence opt4 from hemagglutinin__InfluenzaA__ABG88696

SEQ ID NO: 153683 - RNA, 1701 nt, Artificial Sequence; identical to SEQ ID NO: 152802
  derived and/or modified sequence opt4 from hemagglutinin__InfluenzaA__ABG88707

SEQ ID NO: 153684 - RNA, 1701 nt, Artificial Sequence; identical to SEQ ID NO: 152802
  derived and/or modified sequence opt4 from hemagglutinin__InfluenzaA__ABG88718

SEQ ID NO: 153685 - RNA, 1701 nt, Artificial Sequence
  derived and/or modified sequence opt4 from hemagglutinin__InfluenzaA__ABG88729
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacagcggcaaguucgacaagcuguacaucuggggcgugcaccaccccagcaccgacagcgaccagaccagccuguacgugagagccagcggcagagugaccgugagcaccaagagaagccagcagaccgugacccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153686 - RNA, 1701 nt, Artificial Sequence
  derived and/or modified sequence opt4 from hemagglutinin__InfluenzaA__ABG88740
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacaucaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153687 - RNA, 1701 nt, Artificial Sequence; identical to SEQ ID NO: 153573
  derived and/or modified sequence opt4 from hemagglutinin__InfluenzaA__ABG88751

SEQ ID NO: 153688 - RNA, 1701 nt, Artificial Sequence
  derived and/or modified sequence opt4 from hemagglutinin__InfluenzaA__ABG88762
augaagaccaucaucgcccugagcuacauccugugccugguguucacccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgccagcaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaggugagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153689 - RNA, 1701 nt, Artificial Sequence
  derived and/or modified sequence opt4 from hemagglutinin__InfluenzaA__ABG88773
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcgccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaccgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153690 - RNA, 1701 nt, Artificial Sequence
  derived and/or modified sequence opt4 from hemagglutinin__InfluenzaA__ABG88784
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucaagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153691 - RNA, 1701 nt, Artificial Sequence
  derived and/or modified sequence opt4 from hemagglutinin__InfluenzaA__ABG88806
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccgugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153692 - RNA, 1704 nt, Artificial Sequence
  derived and/or modified sequence opt4 from hemagglutinin__InfluenzaA__ABI16504
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacgaccugugcuaccccggcaacuucaacgacuacgaggagcugaagcaccugcugagcagaaucaaccacuucgagaagauccagaucaucagcaagagcagcuggagcgaccacgaggccagcagcggcgugagcagcgccugccccuaccagggcacccccagcuucuucagaaacgugguguggcugaucaagaagaacaacaccuaccccaccaucaagagaagcuacaacaacaccaaccaggaggaccugcugauccuguggggcauccaccacagcaacaacgccgccgagcagaccaagcuguaccagaaccccaccaccuacaucagcgugggcaccagcacccugaaccugagacuggugcccaagaucgccaccagaagcaaggugaacggccagagcggcagaauggacuucuucuggaccauccugaagcccaacgacgccaucaacuucgagagcaacggcaacuucaucgcccccgaguacgccuacaagaucgugaagaagggcgacagcgccaucaugaagagcgagguggaguacggcaacugcaacaccaagugccagacccccaucggcgccaucaacagcagcaugcccuuccacaacauccacccccugaccaucggcgagugccccaaguacgugaagagcaacaagcuggugcuggccaccggccugagaaacagcccccugagagagagaagaagaaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 153693 - RNA, 1701 nt, Artificial Sequence; identical to SEQ ID NO: 153153
  derived and/or modified sequence opt4 from hemagglutinin__InfluenzaA__ABI20793

SEQ ID NO: 153694 - RNA, 1701 nt, Artificial Sequence
  derived and/or modified sequence opt4 from hemagglutinin__InfluenzaA__ABI20837
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagacccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153695 - RNA, 1701 nt, Artificial Sequence
  derived and/or modified sequence opt4 from hemagglutinin__InfluenzaA__ABI20848
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugaaggagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgcccacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153696 - RNA, 1701 nt, Artificial Sequence; identical to SEQ ID NO: 153441
  derived and/or modified sequence opt4 from hemagglutinin__InfluenzaA__ABI20859

SEQ ID NO: 153697 - RNA, 1701 nt, Artificial Sequence
  derived and/or modified sequence opt4 from hemagglutinin__InfluenzaA__ABI20870
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcguggccggcuggauccugggcaaccccgagugcgagagccuguucagcaaggagagcuggagcuacaucgccgagacccccaaccccgagaacggcaccugcuaccccggcaacuucgccgacuacgaggagcugagagagcagcugagcagcgugagcagcuucgagagauucgagaucuuccccaaggagagcagcuggcccaaccacaccgugaccaagggcgugaccgugagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaugagagaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153698 - RNA, 1701 nt, Artificial Sequence; identical to SEQ ID NO: 153509
  derived and/or modified sequence opt4 from hemagglutinin__InfluenzaA__ABI20881

SEQ ID NO: 153699 - RNA, 1701 nt, Artificial Sequence
  derived and/or modified sequence opt4 from hemagglutinin__InfluenzaA__ABI20892
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaaggagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcauccacuggaccaucgugaagcccggcgacauccugcugaucaccagcaccggcaaccugaucgcccccagaggcuacuucaagaucagaaacggcaagagcagcaucaugagaagcgacgcccccaucggcaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153700 - RNA, 1701 nt, Artificial Sequence
  derived and/or modified sequence opt4 from hemagglutinin__InfluenzaA__ABI20903
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugauccacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153701 - RNA, 1701 nt, Artificial Sequence
  derived and/or modified sequence opt4 from hemagglutinin__InfluenzaA__ABI20914
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugagccugggcuucaucaugugggccugccagaagggcaacaucagaugcaacaucugcaucuga

SEQ ID NO: 153702 - RNA, 1701 nt, Artificial Sequence; identical to SEQ ID NO: 153586
  derived and/or modified sequence opt4 from hemagglutinin__InfluenzaA__ABI20925

SEQ ID NO: 153703 - RNA, 1701 nt, Artificial Sequence; identical to SEQ ID NO: 153586
  derived and/or modified sequence opt4 from hemagglutinin__InfluenzaA__ABI20936

SEQ ID NO: 153704 - RNA, 1701 nt, Artificial Sequence
  derived and/or modified sequence opt4 from hemagglutinin__InfluenzaA__ABI20947
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagcaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153705 - RNA, 1701 nt, Artificial Sequence
  derived and/or modified sequence opt4 from hemagglutinin__InfluenzaA__ABI20958
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcuguacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153706 - RNA, 1701 nt, Artificial Sequence
  derived and/or modified sequence opt4 from hemagglutinin__InfluenzaA__ABI20969
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggaguggaaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153707 - RNA, 1701 nt, Artificial Sequence
  derived and/or modified sequence opt4 from hemagglutinin__InfluenzaA__ABI20980
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggaccagaacggcaccagcagcgccugcaagagaagaagcaccaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugacccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccugaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagauccugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153708 - RNA, 1701 nt, Artificial Sequence
  derived and/or modified sequence opt4 from hemagglutinin__InfluenzaA__ABI20991
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaucaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153709 - RNA, 1701 nt, Artificial Sequence; identical to SEQ ID NO: 153230
  derived and/or modified sequence opt4 from hemagglutinin__InfluenzaA__ABI21002

SEQ ID NO: 153710 - RNA, 1701 nt, Artificial Sequence; identical to SEQ ID NO: 153674
  derived and/or modified sequence opt4 from hemagglutinin__InfluenzaA__ABI21013

SEQ ID NO: 153711 - RNA, 1701 nt, Artificial Sequence; identical to SEQ ID NO: 153160
  derived and/or modified sequence opt4 from hemagglutinin__InfluenzaA__ABI21024

SEQ ID NO: 153712 - RNA, 1701 nt, Artificial Sequence; identical to SEQ ID NO: 153036
  derived and/or modified sequence opt4 from hemagglutinin__InfluenzaA__ABI21035

SEQ ID NO: 153713 - RNA, 1701 nt, Artificial Sequence
  derived and/or modified sequence opt4 from hemagglutinin__InfluenzaA__ABI21046
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153714 - RNA, 1701 nt, Artificial Sequence
  derived and/or modified sequence opt4 from hemagglutinin__InfluenzaA__ABI21057
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagaacagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153715 - RNA, 1701 nt, Artificial Sequence; identical to SEQ ID NO: 152763
  derived and/or modified sequence opt4 from hemagglutinin__InfluenzaA__ABI21068

SEQ ID NO: 153716 - RNA, 1701 nt, Artificial Sequence; identical to SEQ ID NO: 152802
  derived and/or modified sequence opt4 from hemagglutinin__InfluenzaA__ABI21079

SEQ ID NO: 153717 - RNA, 1701 nt, Artificial Sequence; identical to SEQ ID NO: 153633
  derived and/or modified sequence opt4 from hemagglutinin__InfluenzaA__ABI21090

SEQ ID NO: 153718 - RNA, 1701 nt, Artificial Sequence; identical to SEQ ID NO: 153633
  derived and/or modified sequence opt4 from hemagglutinin__InfluenzaA__ABI21101

SEQ ID NO: 153719 - RNA, 1701 nt, Artificial Sequence
  derived and/or modified sequence opt4 from hemagglutinin__InfluenzaA__ABI21123
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaagcacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153720 - RNA, 1701 nt, Artificial Sequence
  derived and/or modified sequence opt4 from hemagglutinin__InfluenzaA__ABI21134
augaagaccaucaucgcccugagcuacauccugugccugguguucgcccagaagcugcccggcaacgacaacagcaccgccacccugugccugggccaccacgccgugcccaacggcaccguggugaagaccaucaccaacgaccagaucgaggugaccaacgccaccgagcuggugcagagcagcagcaccggcggcaucugcgacagcccccaccagauccuggacggcgagaacugcacccugauggacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagaagcagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153721 - RNA, 1701 nt, Artificial Sequence; identical to SEQ ID NO: 152802
  derived and/or modified sequence opt4 from hemagglutinin__InfluenzaA__ABI21156

SEQ ID NO: 153722 - RNA, 1701 nt, Artificial Sequence
  derived and/or modified sequence opt4 from hemagglutinin__InfluenzaA__ABI21167
augaagaccaucaucgcccugggcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgagguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153723 - RNA, 1701 nt, Artificial Sequence
  derived and/or modified sequence opt4 from hemagglutinin__InfluenzaA__ABI21178
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcagcugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153724 - RNA, 1698 nt, Artificial Sequence
  derived and/or modified sequence opt4 from hemagglutinin__InfluenzaA__ABI21200
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153725 - RNA, 1698 nt, Artificial Sequence; identical to SEQ ID NO: 153724
  derived and/or modified sequence opt4 from hemagglutinin__InfluenzaA__ABI21211

SEQ ID NO: 153726 - RNA, 1698 nt, Artificial Sequence
  derived and/or modified sequence opt4 from hemagglutinin__InfluenzaA__ABI21233
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugaacagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153727 - RNA, 1701 nt, Artificial Sequence
  derived and/or modified sequence opt4 from hemagglutinin__InfluenzaA__ABI21244
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccugaaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153728 - RNA, 1701 nt, Artificial Sequence; identical to SEQ ID NO: 153573
  derived and/or modified sequence opt4 from hemagglutinin__InfluenzaA__ABI21255

SEQ ID NO: 153729 - RNA, 1701 nt, Artificial Sequence; identical to SEQ ID NO: 153573
  derived and/or modified sequence opt4 from hemagglutinin__InfluenzaA__ABI21266

SEQ ID NO: 153730 - RNA, 1701 nt, Artificial Sequence; identical to SEQ ID NO: 153573
  derived and/or modified sequence opt4 from hemagglutinin__InfluenzaA__ABI21277

SEQ ID NO: 153731 - RNA, 1701 nt, Artificial Sequence
  derived and/or modified sequence opt4 from hemagglutinin__InfluenzaA__ABI21299
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153732 - RNA, 1701 nt, Artificial Sequence; identical to SEQ ID NO: 153573
  derived and/or modified sequence opt4 from hemagglutinin__InfluenzaA__ABI21310

SEQ ID NO: 153733 - RNA, 1701 nt, Artificial Sequence
  derived and/or modified sequence opt4 from hemagglutinin__InfluenzaA__ABI21321
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153734 - RNA, 1701 nt, Artificial Sequence
  derived and/or modified sequence opt4 from hemagglutinin__InfluenzaA__ABI21332
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153735 - RNA, 1701 nt, Artificial Sequence; identical to SEQ ID NO: 153573
  derived and/or modified sequence opt4 from hemagglutinin__InfluenzaA__ABI21343

SEQ ID NO: 153736 - RNA, 1701 nt, Artificial Sequence
  derived and/or modified sequence opt4 from hemagglutinin__InfluenzaA__ABI21354
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153737 - RNA, 1701 nt, Artificial Sequence
  derived and/or modified sequence opt4 from hemagglutinin__InfluenzaA__ABI21365
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagauggacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153738 - RNA, 1701 nt, Artificial Sequence
  derived and/or modified sequence opt4 from hemagglutinin__InfluenzaA__ABI21376
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153739 - RNA, 1701 nt, Artificial Sequence; identical to SEQ ID NO: 153573
  derived and/or modified sequence opt4 from hemagglutinin__InfluenzaA__ABI21387

SEQ ID NO: 153740 - RNA, 1701 nt, Artificial Sequence
  derived and/or modified sequence opt4 from hemagglutinin__InfluenzaA__ABI21398
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucgugaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153741 - RNA, 1701 nt, Artificial Sequence; identical to SEQ ID NO: 153573
  derived and/or modified sequence opt4 from hemagglutinin__InfluenzaA__ABI21409

SEQ ID NO: 153742 - RNA, 1701 nt, Artificial Sequence
  derived and/or modified sequence opt4 from hemagglutinin__InfluenzaA__ABI21420
augaagaccaucaucgcccugagcuacauccugugccugguguucacccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcggcagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagagcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153743 - RNA, 1701 nt, Artificial Sequence; identical to SEQ ID NO: 153573
  derived and/or modified sequence opt4 from hemagglutinin__InfluenzaA__ABI21431

SEQ ID NO: 153744 - RNA, 1701 nt, Artificial Sequence; identical to SEQ ID NO: 153573
  derived and/or modified sequence opt4 from hemagglutinin__InfluenzaA__ABI21442

SEQ ID NO: 153745 - RNA, 1701 nt, Artificial Sequence; identical to SEQ ID NO: 153573
  derived and/or modified sequence opt4 from hemagglutinin__InfluenzaA__ABI21453

SEQ ID NO: 153746 - RNA, 1701 nt, Artificial Sequence; identical to SEQ ID NO: 153573
  derived and/or modified sequence opt4 from hemagglutinin__InfluenzaA__ABI21464

SEQ ID NO: 153747 - RNA, 1701 nt, Artificial Sequence; identical to SEQ ID NO: 153573
  derived and/or modified sequence opt4 from hemagglutinin__InfluenzaA__ABI21475

SEQ ID NO: 153748 - RNA, 1701 nt, Artificial Sequence
  derived and/or modified sequence opt4 from hemagglutinin__InfluenzaA__ABI21486
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcagcagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggaggccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153749 - RNA, 1701 nt, Artificial Sequence; identical to SEQ ID NO: 153573
  derived and/or modified sequence opt4 from hemagglutinin__InfluenzaA__ABI21497

SEQ ID NO: 153750 - RNA, 1698 nt, Artificial Sequence
  derived and/or modified sequence opt4 from hemagglutinin__InfluenzaA__ABI21530
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgugcagagagccaucuacagaaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucgagagcggcaucaucaccagcaacgcccccaugaacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153751 - RNA, 1698 nt, Artificial Sequence
  derived and/or modified sequence opt4 from hemagglutinin__InfluenzaA__ABI21552
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgugcagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucgagagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153752 - RNA, 1698 nt, Artificial Sequence
  derived and/or modified sequence opt4 from hemagglutinin__InfluenzaA__ABI21563
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgugcagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucgagagcggcaucaucaccagcaacgcccccaugaacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153753 - RNA, 1698 nt, Artificial Sequence; identical to SEQ ID NO: 153752
  derived and/or modified sequence opt4 from hemagglutinin__InfluenzaA__ABI21574

SEQ ID NO: 153754 - RNA, 1701 nt, Artificial Sequence
  derived and/or modified sequence opt4 from hemagglutinin__InfluenzaA__ABI21736
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacgugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153755 - RNA, 1701 nt, Artificial Sequence
  derived and/or modified sequence opt4 from hemagglutinin__InfluenzaA__ABI22159
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaacgccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153756 - RNA, 1707 nt, Artificial Sequence
  derived and/or modified sequence opt4 from hemagglutinin__InfluenzaA__ABI23979
auggagaagaucgugcugcugcuggccaucaucagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguuccugaacgugcccgaguggagcuacaucguggagaagaucaaccccgccaacgaccugugcuaccccggcaacuucaacgacuacgaggagcugaagcaccugcugagcagaaucaaccacuucgagaagauccagaucauccccaagagcagcuggagcgaccacgaggccagcagcggcgugagcagcgccugccccuaccagggcagaagcagcuucuucagaaacgugguguggcugaucaagaaggacaacgccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgagaacgccuacaagaucgugaagaagggcgacagcaccaucaugaagagcgagcuggaguacggcaacugcaacaccaagugccagacccccaucggcgccaucaacagcagcaugcccuuccacaacauccacccccugaccaucggcgagugccccaaguacgugaagagcaacagacuggugcuggccaccggccugagaaacagcccccagggcgagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacagaugcgacaacgagugcauggagagcgugagaaacggcaccuacgacuacccccaguacagcgaggagagcagacugaagagagaggagaucagcggcgugaagcuggagagcaucggcaccuaccagauccugagcaucuacagcaccguggccagcagccuggcccuggccaucaugguggccggccugagccuguggaugugcagcaacggcagccugcagugcagaaucugcaucuga

SEQ ID NO: 153757 - RNA, 1701 nt, Artificial Sequence; identical to SEQ ID NO: 152802
  derived and/or modified sequence opt4 from hemagglutinin__InfluenzaA__ABI26646

SEQ ID NO: 153758 - RNA, 1701 nt, Artificial Sequence; identical to SEQ ID NO: 153431
  derived and/or modified sequence opt4 from hemagglutinin__InfluenzaA__ABI30367

SEQ ID NO: 153759 - RNA, 1701 nt, Artificial Sequence; identical to SEQ ID NO: 153441
  derived and/or modified sequence opt4 from hemagglutinin__InfluenzaA__ABI30378

SEQ ID NO: 153760 - RNA, 1701 nt, Artificial Sequence; identical to SEQ ID NO: 153170
  derived and/or modified sequence opt4 from hemagglutinin__InfluenzaA__ABI30400

SEQ ID NO: 153761 - RNA, 1701 nt, Artificial Sequence
  derived and/or modified sequence opt4 from hemagglutinin__InfluenzaA__ABI30411
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagauggacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153762 - RNA, 1701 nt, Artificial Sequence; identical to SEQ ID NO: 153111
  derived and/or modified sequence opt4 from hemagglutinin__InfluenzaA__ABI30422

SEQ ID NO: 153763 - RNA, 1701 nt, Artificial Sequence; identical to SEQ ID NO: 152802
  derived and/or modified sequence opt4 from hemagglutinin__InfluenzaA__ABI30433

SEQ ID NO: 153764 - RNA, 1701 nt, Artificial Sequence; identical to SEQ ID NO: 153111
  derived and/or modified sequence opt4 from hemagglutinin__InfluenzaA__ABI30444

SEQ ID NO: 153765 - RNA, 1701 nt, Artificial Sequence; identical to SEQ ID NO: 152802
  derived and/or modified sequence opt4 from hemagglutinin__InfluenzaA__ABI30455

SEQ ID NO: 153766 - RNA, 1701 nt, Artificial Sequence; identical to SEQ ID NO: 152802
  derived and/or modified sequence opt4 from hemagglutinin__InfluenzaA__ABI30466

SEQ ID NO: 153767 - RNA, 1701 nt, Artificial Sequence; identical to SEQ ID NO: 152802
  derived and/or modified sequence opt4 from hemagglutinin__InfluenzaA__ABI30477

SEQ ID NO: 153768 - RNA, 1701 nt, Artificial Sequence; identical to SEQ ID NO: 152802
  derived and/or modified sequence opt4 from hemagglutinin__InfluenzaA__ABI30488

SEQ ID NO: 153769 - RNA, 1701 nt, Artificial Sequence; identical to SEQ ID NO: 152802
  derived and/or modified sequence opt4 from hemagglutinin__InfluenzaA__ABI30499

SEQ ID NO: 153770 - RNA, 1701 nt, Artificial Sequence; identical to SEQ ID NO: 152763
  derived and/or modified sequence opt4 from hemagglutinin__InfluenzaA__ABI30510

SEQ ID NO: 153771 - RNA, 1701 nt, Artificial Sequence
  derived and/or modified sequence opt4 from hemagglutinin__InfluenzaA__ABI30521
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153772 - RNA, 1701 nt, Artificial Sequence; identical to SEQ ID NO: 152802
  derived and/or modified sequence opt4 from hemagglutinin__InfluenzaA__ABI30532

SEQ ID NO: 153773 - RNA, 1701 nt, Artificial Sequence; identical to SEQ ID NO: 153633
  derived and/or modified sequence opt4 from hemagglutinin__InfluenzaA__ABI30543

SEQ ID NO: 153774 - RNA, 1701 nt, Artificial Sequence; identical to SEQ ID NO: 152802
  derived and/or modified sequence opt4 from hemagglutinin__InfluenzaA__ABI30554

SEQ ID NO: 153775 - RNA, 1698 nt, Artificial Sequence; identical to SEQ ID NO: 153724
  derived and/or modified sequence opt4 from hemagglutinin__InfluenzaA__ABI30565

SEQ ID NO: 153776 - RNA, 1701 nt, Artificial Sequence; identical to SEQ ID NO: 153153
  derived and/or modified sequence opt4 from hemagglutinin__InfluenzaA__ABI30587

SEQ ID NO: 153777 - RNA, 1701 nt, Artificial Sequence
  derived and/or modified sequence opt4 from hemagglutinin__InfluenzaA__ABI30609
augaagaccaucaucgcccugagcuacauccugugccugguguucgcccagaagcugcccggcaacgacaacagcaccgccacccugugccugggccaccacgccgugcccaacggcaccaucgugaagaccaucaugaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153778 - RNA, 1701 nt, Artificial Sequence
  derived and/or modified sequence opt4 from hemagglutinin__InfluenzaA__ABI30620
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucaucgagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagguggaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153779 - RNA, 1701 nt, Artificial Sequence; identical to SEQ ID NO: 153153
  derived and/or modified sequence opt4 from hemagglutinin__InfluenzaA__ABI30733

SEQ ID NO: 153780 - RNA, 1701 nt, Artificial Sequence; identical to SEQ ID NO: 153153
  derived and/or modified sequence opt4 from hemagglutinin__InfluenzaA__ABI30744

SEQ ID NO: 153781 - RNA, 1701 nt, Artificial Sequence; identical to SEQ ID NO: 153153
  derived and/or modified sequence opt4 from hemagglutinin__InfluenzaA__ABI30755

SEQ ID NO: 153782 - RNA, 1701 nt, Artificial Sequence; identical to SEQ ID NO: 153153
  derived and/or modified sequence opt4 from hemagglutinin__InfluenzaA__ABI30766

SEQ ID NO: 153783 - RNA, 1701 nt, Artificial Sequence; identical to SEQ ID NO: 153153
  derived and/or modified sequence opt4 from hemagglutinin__InfluenzaA__ABI30777

SEQ ID NO: 153784 - RNA, 1701 nt, Artificial Sequence
  derived and/or modified sequence opt4 from hemagglutinin__InfluenzaA__ABI30788
augaagaccaucaucgcccugagcuacauccugugccugguguucgcccagaagcugagcggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153785 - RNA, 1701 nt, Artificial Sequence; identical to SEQ ID NO: 153153
  derived and/or modified sequence opt4 from hemagglutinin__InfluenzaA__ABI30799

SEQ ID NO: 153786 - RNA, 1701 nt, Artificial Sequence
  derived and/or modified sequence opt4 from hemagglutinin__InfluenzaA__ABI30810
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucaagaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153787 - RNA, 1701 nt, Artificial Sequence
  derived and/or modified sequence opt4 from hemagglutinin__InfluenzaA__ABI30821
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacguggccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153788 - RNA, 1701 nt, Artificial Sequence; identical to SEQ ID NO: 153153
  derived and/or modified sequence opt4 from hemagglutinin__InfluenzaA__ABI30832

SEQ ID NO: 153789 - RNA, 1701 nt, Artificial Sequence
  derived and/or modified sequence opt4 from hemagglutinin__InfluenzaA__ABI30843
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153790 - RNA, 1701 nt, Artificial Sequence; identical to SEQ ID NO: 153733
  derived and/or modified sequence opt4 from hemagglutinin__InfluenzaA__ABI30865

SEQ ID NO: 153791 - RNA, 1707 nt, Artificial Sequence
  derived and/or modified sequence opt4 from hemagglutinin__InfluenzaA__ABI36155
auggagaagaucgugcugcugcuggccaccgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacggccugugcuaccccggcaacuucaacgacuacgaggagcugaagcaccugcugagcagaaucaaccacuucgagaagcugcagaucauccccaagagcagcuggagcgaccacgaggccagccugggcgugagcagcgccugccccuaccugggcagaagcagcuucuucagaaacgugguguggcugaucaagaagaacaacaccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcgacugcaacaccaagugccagacccccaugggcgccaucaacagcagcaugccccugcacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaucuaccagauccugagcaucuacagcaccguggccagcagccuggcccuggccaucaugauggccggccugagccuguggaugugcagcaacggcagccugcagugcagagugugcaucuga

SEQ ID NO: 153792 - RNA, 1707 nt, Artificial Sequence
  derived and/or modified sequence opt4 from hemagglutinin__InfluenzaA__ABI36166
auggagaagaucgugcugcugcuggccaccgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacggccugugcuaccccggcaacuucaacgacuacgaggagcugaagcaccugcugagcagaaucaaccacuucgagaagcugcagaucauccccaagagcagcuggagcgaccacgaggccagccugggcgugagcagcgccugccccuaccugggcagaagcagcuucuucagaaacgugguguggcugaucaagaagaacaacaccuaccccaccaucaagagaagcuacaacaacaccaaccaggaggaccugcuggugcuguggggcauccaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcgacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaucuaccagauccugagcaucuacagcaccguggccagcagccuggcccuggccaucaugauggccggccugagccuguggaugugcagcaacggcagccugcagugcagagugugcaucuga

SEQ ID NO: 153793 - RNA, 1707 nt, Artificial Sequence; identical to SEQ ID NO: 153792
  derived and/or modified sequence opt4 from hemagglutinin__InfluenzaA__ABI36177

SEQ ID NO: 153794 - RNA, 1707 nt, Artificial Sequence
  derived and/or modified sequence opt4 from hemagglutinin__InfluenzaA__ABI36406
auggagaagaucgugcugcugcuggccaccgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgccaacggccugugcuaccccggcaacuucaacgacuacgaggagcugaagcaccugcugagcagaaucaaccacuucgagaagcugcagaucauccccaagagcagcuggagcgaccacgaggccagccugggcgugagcagcgccugccccuaccugggcagaagcagcuucuucagaaacgugguguggcugaucaagaagaacaacaccuaccccaccaucaagagaagcuacaacaacaccaaccaggaggaccugcuggugcuguggggccugcaccaccccaacgacgccgccgagcagaccagacuguaccagaaccccaccaccuacaucagcgugggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcgacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaucuaccagauccugagcaucuacagcaccguggccagcagccuggcccuggccaucaugauggccggccugagccuguggaugugcagcaacggcagccugcagugcagagugugcaucuga

SEQ ID NO: 153795 - RNA, 1707 nt, Artificial Sequence
  derived and/or modified sequence opt4 from hemagglutinin__InfluenzaA__ABI36450
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccugggcaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaccagcuacaacaacaccaaccaggaggaccugcuggugcuguggggcauccaccacagcaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 153796 - RNA, 1707 nt, Artificial Sequence
  derived and/or modified sequence opt4 from hemagglutinin__InfluenzaA__ABI49396
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccugggcaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucugggccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 153797 - RNA, 1704 nt, Artificial Sequence
  derived and/or modified sequence opt4 from hemagglutinin__InfluenzaA__ABI85000
augaacacccagauccuggccuucaucgccugcaugcugaucggcaccaagggcgacaagaucugccugggccaccacgccguggccaacggcaccaaggugaacacccugaccgagagaggcaucgagguggugaacgccaccgagaccguggagaccgugaacaucaagaagaucugcacccagggcaagagacccaccgaccugggccagugcggccugcugggcacccugaucggccccccccagugcgaccaguuccuggaguucgacgccaaccugaucaucgagagaagagagggcaccgacgugugcuaccccggcaaguucaccaacgaggagagccugagacagauccugagaggcagcggcggcaucgacaaggagagcaugggcuucaccuacagcggcaucagaaccaacggcgccaccagcgccugcagaagaagcggcagcagcuucuacgccgagaugaaguggcugcugagcaacagcgacaacgccgccuucccccagaugaccaagagcuacagaaaccccagaaacaagcccgcccugaucaucuggggcgugcaccacagcggcagcgccaccgagcagaccaagcuguacggcagcggcaacaagcugaucaccgugggcagcagcaaguaccagcagagcuucacccccagccccggcgccagaccccaggugaacggccagagcggcagaaucgacuuccacuggcugcugcuggaccccaacgacaccgugaccuucaccuucaacggcgccuucaucgcccccgacagagccagcuucuucagaggcgagagccugggcgugcagagcgacgugccccuggacagcggcugcgagggcgacugcuuccacagcggcggcaccaucgugagcagccugcccuuccagaacaucaaccccagaaccgugggcaagugccccagauacgugaagcagaccagccugcugcuggccaccggcaugagaaacgugcccgagaaccccaagcaggccuaccagaagagaaugaccagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgacaagaccaaccagcaguucgagcugaucgacaacgaguucagcgagaucgagcagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugagaaagcagcugagagagaacgccgaggaggacggcaccggcugcuucgagaucuuccacaagugcgacgaccagugcauggagagcaucagaaacaacaccuacgaccacacccaguacagaaccgagagccugcagaacagaauccagaucgaccccgugaagcugagcagcggcuacaaggacaucauccugugguucagcuucggcgccagcugcuuccugcugcuggccaucgccaugggccugguguucaucugcaucaagaacggcaacaugagaugcaccaucugcaucuga

SEQ ID NO: 153798 - RNA, 1701 nt, Artificial Sequence; identical to SEQ ID NO: 153350
  derived and/or modified sequence opt4 from hemagglutinin__InfluenzaA__ABI92291

SEQ ID NO: 153799 - RNA, 1701 nt, Artificial Sequence
  derived and/or modified sequence opt4 from hemagglutinin__InfluenzaA__ABI92302
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153800 - RNA, 1701 nt, Artificial Sequence
  derived and/or modified sequence opt4 from hemagglutinin__InfluenzaA__ABI92313
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcaucagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccacauccuggccaucuacagcaccguggccagcagccuggugcugcuggugagccugggcgccaucagcuucuggaugugcagcaacggcagccugcagugcagaaucugcaucuga

SEQ ID NO: 153801 - RNA, 1701 nt, Artificial Sequence
  derived and/or modified sequence opt4 from hemagglutinin__InfluenzaA__ABI92324
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153802 - RNA, 1701 nt, Artificial Sequence
  derived and/or modified sequence opt4 from hemagglutinin__InfluenzaA__ABI92335
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccagcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaugggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugaugggcuucaucaugugggccugccagaagggcaacaucagaugcaacaucugcaucuga

SEQ ID NO: 153803 - RNA, 1701 nt, Artificial Sequence
  derived and/or modified sequence opt4 from hemagglutinin__InfluenzaA__ABI92346
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccacaucaagggcguggagcugaagagcggcuacaaggacugggugcuguggaucagcuucgccaucagcugcuuccugcugugcaucgugcugcugggcuucaucaugugggccugccagaagggcaacaucagaugcaacaucugcaucuga

SEQ ID NO: 153804 - RNA, 1701 nt, Artificial Sequence; identical to SEQ ID NO: 152802
  derived and/or modified sequence opt4 from hemagglutinin__InfluenzaA__ABI92357

SEQ ID NO: 153805 - RNA, 1701 nt, Artificial Sequence; identical to SEQ ID NO: 152802
  derived and/or modified sequence opt4 from hemagglutinin__InfluenzaA__ABI92368

SEQ ID NO: 153806 - RNA, 1698 nt, Artificial Sequence; identical to SEQ ID NO: 153724
  derived and/or modified sequence opt4 from hemagglutinin__InfluenzaA__ABI92379

SEQ ID NO: 153807 - RNA, 1701 nt, Artificial Sequence
  derived and/or modified sequence opt4 from hemagglutinin__InfluenzaA__ABI92390
augaagaccaucaucgccuucagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaccagccuguacgcccaggccagcggcagaaucaccgugagcaccaagagaagccagcagaccgugacccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153808 - RNA, 1701 nt, Artificial Sequence; identical to SEQ ID NO: 152802
  derived and/or modified sequence opt4 from hemagglutinin__InfluenzaA__ABI92401

SEQ ID NO: 153809 - RNA, 1701 nt, Artificial Sequence
  derived and/or modified sequence opt4 from hemagglutinin__InfluenzaA__ABI92412
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacaucaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153810 - RNA, 1701 nt, Artificial Sequence
  derived and/or modified sequence opt4 from hemagglutinin__InfluenzaA__ABI92423
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgacaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153811 - RNA, 1701 nt, Artificial Sequence; identical to SEQ ID NO: 153153
  derived and/or modified sequence opt4 from hemagglutinin__InfluenzaA__ABI92434

SEQ ID NO: 153812 - RNA, 1701 nt, Artificial Sequence
  derived and/or modified sequence opt4 from hemagglutinin__InfluenzaA__ABI92445
augaagaccaucaucgcccugagcuacauccugugccugguguucacccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugaaccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153813 - RNA, 1701 nt, Artificial Sequence; identical to SEQ ID NO: 153153
  derived and/or modified sequence opt4 from hemagglutinin__InfluenzaA__ABI92456

SEQ ID NO: 153814 - RNA, 1701 nt, Artificial Sequence; identical to SEQ ID NO: 153761
  derived and/or modified sequence opt4 from hemagglutinin__InfluenzaA__ABI92467

SEQ ID NO: 153815 - RNA, 1701 nt, Artificial Sequence; identical to SEQ ID NO: 153170
  derived and/or modified sequence opt4 from hemagglutinin__InfluenzaA__ABI92478

SEQ ID NO: 153816 - RNA, 1701 nt, Artificial Sequence; identical to SEQ ID NO: 153761
  derived and/or modified sequence opt4 from hemagglutinin__InfluenzaA__ABI92489

SEQ ID NO: 153817 - RNA, 1701 nt, Artificial Sequence
  derived and/or modified sequence opt4 from hemagglutinin__InfluenzaA__ABI92500
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgugaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153818 - RNA, 1701 nt, Artificial Sequence
  derived and/or modified sequence opt4 from hemagglutinin__InfluenzaA__ABI92511
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagaacagcagcaccggcaucaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaccgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagagugagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaagugcaacagcaagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacaccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153819 - RNA, 1701 nt, Artificial Sequence
  derived and/or modified sequence opt4 from hemagglutinin__InfluenzaA__ABI92522
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153820 - RNA, 1701 nt, Artificial Sequence
  derived and/or modified sequence opt4 from hemagglutinin__InfluenzaA__ABI92533
augaagaccaucaucgcccugagcuacauccugugccugguguucgcccagaagcugcccggcaacgacaacagcagagccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153821 - RNA, 1701 nt, Artificial Sequence; identical to SEQ ID NO: 153820
  derived and/or modified sequence opt4 from hemagglutinin__InfluenzaA__ABI92544

SEQ ID NO: 153822 - RNA, 1701 nt, Artificial Sequence
  derived and/or modified sequence opt4 from hemagglutinin__InfluenzaA__ABI92577
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcagagccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153823 - RNA, 1701 nt, Artificial Sequence; identical to SEQ ID NO: 153559
  derived and/or modified sequence opt4 from hemagglutinin__InfluenzaA__ABI92588

SEQ ID NO: 153824 - RNA, 1701 nt, Artificial Sequence
  derived and/or modified sequence opt4 from hemagglutinin__InfluenzaA__ABI92599
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153825 - RNA, 1701 nt, Artificial Sequence
  derived and/or modified sequence opt4 from hemagglutinin__InfluenzaA__ABI92610
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153826 - RNA, 1701 nt, Artificial Sequence
  derived and/or modified sequence opt4 from hemagglutinin__InfluenzaA__ABI92621
augaagaccaucaucgcccugagcuacauccugugccugguguucgcccagaagcugcccggcaacgacaacagcauggccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgagggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcaagaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggccugugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153827 - RNA, 1701 nt, Artificial Sequence; identical to SEQ ID NO: 153082
  derived and/or modified sequence opt4 from hemagglutinin__InfluenzaA__ABI92632

SEQ ID NO: 153828 - RNA, 1701 nt, Artificial Sequence
  derived and/or modified sequence opt4 from hemagglutinin__InfluenzaA__ABI92643
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccauccccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153829 - RNA, 1701 nt, Artificial Sequence
  derived and/or modified sequence opt4 from hemagglutinin__InfluenzaA__ABI92665
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaggcagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagagacagcugagagagaacgccgaggacaugggcaacggcugcuucaagaucuaccacaagugcgacaacgccugcaucggcagcaucagaaacggcaccuacgaccacgacguguacagaaacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153830 - RNA, 1701 nt, Artificial Sequence
  derived and/or modified sequence opt4 from hemagglutinin__InfluenzaA__ABI92676
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153831 - RNA, 1701 nt, Artificial Sequence
  derived and/or modified sequence opt4 from hemagglutinin__InfluenzaA__ABI92687
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaggcagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153832 - RNA, 1701 nt, Artificial Sequence; identical to SEQ ID NO: 153831
  derived and/or modified sequence opt4 from hemagglutinin__InfluenzaA__ABI92698

SEQ ID NO: 153833 - RNA, 1701 nt, Artificial Sequence; identical to SEQ ID NO: 153036
  derived and/or modified sequence opt4 from hemagglutinin__InfluenzaA__ABI92709

SEQ ID NO: 153834 - RNA, 1701 nt, Artificial Sequence
  derived and/or modified sequence opt4 from hemagglutinin__InfluenzaA__ABI92720
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgagagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153835 - RNA, 1701 nt, Artificial Sequence
  derived and/or modified sequence opt4 from hemagglutinin__InfluenzaA__ABI92731
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153836 - RNA, 1701 nt, Artificial Sequence
  derived and/or modified sequence opt4 from hemagglutinin__InfluenzaA__ABI92742
augaagaccaucaucgcccugagcuacauccugugccugguguucagccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153837 - RNA, 1701 nt, Artificial Sequence
  derived and/or modified sequence opt4 from hemagglutinin__InfluenzaA__ABI92753
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccuaccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153838 - RNA, 1701 nt, Artificial Sequence
  derived and/or modified sequence opt4 from hemagglutinin__InfluenzaA__ABI92764
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaggcagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagagacagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153839 - RNA, 1701 nt, Artificial Sequence; identical to SEQ ID NO: 153831
  derived and/or modified sequence opt4 from hemagglutinin__InfluenzaA__ABI92775

SEQ ID NO: 153840 - RNA, 1701 nt, Artificial Sequence; identical to SEQ ID NO: 152763
  derived and/or modified sequence opt4 from hemagglutinin__InfluenzaA__ABI92786

SEQ ID NO: 153841 - RNA, 1701 nt, Artificial Sequence
  derived and/or modified sequence opt4 from hemagglutinin__InfluenzaA__ABI92797
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugaucagcaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153842 - RNA, 1701 nt, Artificial Sequence; identical to SEQ ID NO: 152763
  derived and/or modified sequence opt4 from hemagglutinin__InfluenzaA__ABI92808

SEQ ID NO: 153843 - RNA, 1701 nt, Artificial Sequence; identical to SEQ ID NO: 152763
  derived and/or modified sequence opt4 from hemagglutinin__InfluenzaA__ABI92819

SEQ ID NO: 153844 - RNA, 1701 nt, Artificial Sequence; identical to SEQ ID NO: 152763
  derived and/or modified sequence opt4 from hemagglutinin__InfluenzaA__ABI92841

SEQ ID NO: 153845 - RNA, 1701 nt, Artificial Sequence
  derived and/or modified sequence opt4 from hemagglutinin__InfluenzaA__ABI92852
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcuacagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153846 - RNA, 1701 nt, Artificial Sequence
  derived and/or modified sequence opt4 from hemagglutinin__InfluenzaA__ABI92863
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaaccagagcuucuucagcagacugaacuggcugacccaccugaaguucaaguaccccgcccugaacgugaccaugcccaacaacgagaaguucgacaagcuguacaucuggggcgugcaccaccccggcaccgacagcgaccagaucagccuguacgcccaggcccccggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcagaugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 153847 - RNA, 1701 nt, Artificial Sequence; identical to SEQ ID NO: 152763
  derived and/or modified sequence opt4 from hemagglutinin__InfluenzaA__ABI92874

SEQ ID NO: 153848 - RNA, 1701 nt, Artificial Sequence; identical to SEQ ID NO: 152763
  derived and/or modified sequence opt4 from hemagglutinin__InfluenzaA__ABI92885

SEQ ID NO: 153849 - RNA, 1701 nt, Artificial Sequence
  derived and/or modified sequence opt4 from hemagglutinin__InfluenzaA__ABI92907
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagccccuaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgugagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153850 - RNA, 1701 nt, Artificial Sequence; identical to SEQ ID NO: 152763
  derived and/or modified sequence opt4 from hemagglutinin__InfluenzaA__ABI92918

SEQ ID NO: 153851 - RNA, 1701 nt, Artificial Sequence; identical to SEQ ID NO: 153849
  derived and/or modified sequence opt4 from hemagglutinin__InfluenzaA__ABI92929

SEQ ID NO: 153852 - RNA, 1701 nt, Artificial Sequence
  derived and/or modified sequence opt4 from hemagglutinin__InfluenzaA__ABI92940
augaagaccaucaucgccuucaacuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagaucuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153853 - RNA, 1701 nt, Artificial Sequence
  derived and/or modified sequence opt4 from hemagglutinin__InfluenzaA__ABI92951
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacagcugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153854 - RNA, 1701 nt, Artificial Sequence
  derived and/or modified sequence opt4 from hemagglutinin__InfluenzaA__ABI92962
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaaacaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153855 - RNA, 1701 nt, Artificial Sequence; identical to SEQ ID NO: 153153
  derived and/or modified sequence opt4 from hemagglutinin__InfluenzaA__ABI92973

SEQ ID NO: 153856 - RNA, 1701 nt, Artificial Sequence; identical to SEQ ID NO: 153153
  derived and/or modified sequence opt4 from hemagglutinin__InfluenzaA__ABI92984

SEQ ID NO: 153857 - RNA, 1701 nt, Artificial Sequence
  derived and/or modified sequence opt4 from hemagglutinin__InfluenzaA__ABI92995
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagaaucagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccaaguacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153858 - RNA, 1701 nt, Artificial Sequence; identical to SEQ ID NO: 153153
  derived and/or modified sequence opt4 from hemagglutinin__InfluenzaA__ABI93006

SEQ ID NO: 153859 - RNA, 1701 nt, Artificial Sequence; identical to SEQ ID NO: 153153
  derived and/or modified sequence opt4 from hemagglutinin__InfluenzaA__ABI93017

SEQ ID NO: 153860 - RNA, 1698 nt, Artificial Sequence; identical to SEQ ID NO: 153752
  derived and/or modified sequence opt4 from hemagglutinin__InfluenzaA__ABI93028

SEQ ID NO: 153861 - RNA, 1701 nt, Artificial Sequence; identical to SEQ ID NO: 153486
  derived and/or modified sequence opt4 from hemagglutinin__InfluenzaA__ABI93039

SEQ ID NO: 153862 - RNA, 1701 nt, Artificial Sequence
  derived and/or modified sequence opt4 from hemagglutinin__InfluenzaA__ABI93061
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153863 - RNA, 1701 nt, Artificial Sequence; identical to SEQ ID NO: 153170
  derived and/or modified sequence opt4 from hemagglutinin__InfluenzaA__ABI93072

SEQ ID NO: 153864 - RNA, 1701 nt, Artificial Sequence; identical to SEQ ID NO: 153170
  derived and/or modified sequence opt4 from hemagglutinin__InfluenzaA__ABI93083

SEQ ID NO: 153865 - RNA, 1701 nt, Artificial Sequence; identical to SEQ ID NO: 153170
  derived and/or modified sequence opt4 from hemagglutinin__InfluenzaA__ABI93094

SEQ ID NO: 153866 - RNA, 1701 nt, Artificial Sequence; identical to SEQ ID NO: 153170
  derived and/or modified sequence opt4 from hemagglutinin__InfluenzaA__ABI93105

SEQ ID NO: 153867 - RNA, 1701 nt, Artificial Sequence
  derived and/or modified sequence opt4 from hemagglutinin__InfluenzaA__ABI93116
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaugagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacggcguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153868 - RNA, 1689 nt, Artificial Sequence
  derived and/or modified sequence opt4 from hemagglutinin__InfluenzaA__ABI94581
augaacacccagauccugguguucgcccugguggccagcauccccaccaacgccgacaagaucugccugggccaccacgccgugagcaacggcaccaaggugaacacccugaccgagagaggcguggagguggugaacgccaccgagaccguggagagaaccaacgugcccagaaucugcagcaagggcaagagaaccguggaccugggccagugcggccugcugggcaccaucaccggccccccccagugcgaccaguuccuggaguucagcgccgaccugaucaucgagagaagagagggcagcgacgugugcuaccccggcaaguucgugaacgaggaggcccugagacagauccugagagagagcggcggcaucgacaaggagaccaugggcuucaccuacagcggcaucagaaccaacggcaccaccagcgccugcagaagaagcggcagcagcuucuacgccgagaugaaguggcugcugagcaacaccgacaacgccgccuucccccagaugaccaagagcuacaagaacaccagaaaggaccccgcccugaucaucuggggcauccaccacagcggcagcaccaccgagcagaccaagcuguacggcagcggcaacaagcugaucaccgugggcagcagcaacuaccagcagagcuucgugcccagccccggcgccagaccccaggugaacggccagagcggcagaaucgacuuccacuggcugauccugaaccccaacgacaccgugaccuucagcuucaacggcgccuucaucgcccccgacagagccagcuuccugagaggcaagagcaugggcauccagagcgaggugcagguggacgccaacugcgagggcgacugcuaccacagcggcggcaccaucaucagcaaccugcccuuccagaacaucaacagcagagccgugggcaagugccccagauacgugaagcaggagagccugcugcuggccaccggcaugaagaacgugcccgagauccccaagagaagaagaagaggccuguucggcgccaucgccggcuucaucgagaacggcugggagggccugaucgacggcugguacggcuucagacaccagaacgcccagggcgagggcaccgccgccgacuacaagagcacccagagcgccaucgaccagaucaccggcaagcugaacagacugaucgagaagaccaaccagcaguucgagcugaucgacaacgaguucaccgagguggagaagcagaucggcaacgugaucaacuggaccagagacagcaugaccgagguguggagcuacaacgccgagcugcugguggccauggagaaccagcacaccaucgaccuggccgacagcgagaugaacaagcuguacgagagagugaagagacagcugagagagaacgccgaggaggacggcaccggcugcuucgagaucuuccacaagugcgacgacgacugcauggccagcaucagaaacaacaccuacgaccacagcaaguacagagaggaggccauccagaacagaauccagaucgaccccgugaagcugagcagcggcuacaaggacgugauccugugguucagcuucggcgccagcugcuucauccugcuggccaucgccaugggccugguguucaucugcgugaagaacggcaacaugagaugcaccaucugcaucuga

SEQ ID NO: 153869 - RNA, 1701 nt, Artificial Sequence; identical to SEQ ID NO: 153286
  derived and/or modified sequence opt4 from hemagglutinin__InfluenzaA__ABI95228

SEQ ID NO: 153870 - RNA, 1701 nt, Artificial Sequence
  derived and/or modified sequence opt4 from hemagglutinin__InfluenzaA__ABI95239
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcauggugaacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153871 - RNA, 1698 nt, Artificial Sequence
  derived and/or modified sequence opt4 from hemagglutinin__InfluenzaA__ABI95250
augaaggccaagcugcuggugcugcugugcaccuucaccgccaccuacgccgacaccaucugcgugggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugaacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153872 - RNA, 1698 nt, Artificial Sequence
  derived and/or modified sequence opt4 from hemagglutinin__InfluenzaA__ABI95261
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgugcagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucgagagcggcaucaucaccagcaacgcccccaugaacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153873 - RNA, 1698 nt, Artificial Sequence; identical to SEQ ID NO: 153752
  derived and/or modified sequence opt4 from hemagglutinin__InfluenzaA__ABI95272

SEQ ID NO: 153874 - RNA, 1698 nt, Artificial Sequence; identical to SEQ ID NO: 153752
  derived and/or modified sequence opt4 from hemagglutinin__InfluenzaA__ABI95283

SEQ ID NO: 153875 - RNA, 1698 nt, Artificial Sequence; identical to SEQ ID NO: 152816
  derived and/or modified sequence opt4 from hemagglutinin__InfluenzaA__ABI95294

SEQ ID NO: 153876 - RNA, 1698 nt, Artificial Sequence
  derived and/or modified sequence opt4 from hemagglutinin__InfluenzaA__ABI96104
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugaucaagagcuacgccaacaacaaggagaaggaggugcugauccuguggggcgugcaccacccccccaacaucggcgaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153877 - RNA, 1701 nt, Artificial Sequence; identical to SEQ ID NO: 153170
  derived and/or modified sequence opt4 from hemagglutinin__InfluenzaA__ABJ09107

SEQ ID NO: 153878 - RNA, 1701 nt, Artificial Sequence
  derived and/or modified sequence opt4 from hemagglutinin__InfluenzaA__ABJ09140
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaucaacgaggacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcagagugaccgugagcaccaagagaagccagcagaccgugauccccaacaucggcuucagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccggccugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153879 - RNA, 1698 nt, Artificial Sequence
  derived and/or modified sequence opt4 from hemagglutinin__InfluenzaA__ABJ09151
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaagggcagcagcuggcccaaccacaccgugaccggcgugagcgccagcugcagccacaacggcaagagcagcuucuacagaaaccugcuguggcugaccggcaagaacggccuguaccccaaccugagcaugagcuacgugaacaacaagggcaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccaugggcgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153880 - RNA, 1701 nt, Artificial Sequence
  derived and/or modified sequence opt4 from hemagglutinin__InfluenzaA__ABJ09162
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccaacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagauccugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153881 - RNA, 1701 nt, Artificial Sequence; identical to SEQ ID NO: 152763
  derived and/or modified sequence opt4 from hemagglutinin__InfluenzaA__ABJ09173

SEQ ID NO: 153882 - RNA, 1698 nt, Artificial Sequence
  derived and/or modified sequence opt4 from hemagglutinin__InfluenzaA__ABJ09184
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggaggccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153883 - RNA, 1701 nt, Artificial Sequence; identical to SEQ ID NO: 153153
  derived and/or modified sequence opt4 from hemagglutinin__InfluenzaA__ABJ09195

SEQ ID NO: 153884 - RNA, 1701 nt, Artificial Sequence; identical to SEQ ID NO: 153153
  derived and/or modified sequence opt4 from hemagglutinin__InfluenzaA__ABJ09206

SEQ ID NO: 153885 - RNA, 1701 nt, Artificial Sequence; identical to SEQ ID NO: 153733
  derived and/or modified sequence opt4 from hemagglutinin__InfluenzaA__ABJ09217

SEQ ID NO: 153886 - RNA, 1701 nt, Artificial Sequence; identical to SEQ ID NO: 153170
  derived and/or modified sequence opt4 from hemagglutinin__InfluenzaA__ABJ09228

SEQ ID NO: 153887 - RNA, 1701 nt, Artificial Sequence
  derived and/or modified sequence opt4 from hemagglutinin__InfluenzaA__ABJ09239
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcaccauggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153888 - RNA, 1701 nt, Artificial Sequence
  derived and/or modified sequence opt4 from hemagglutinin__InfluenzaA__ABJ09250
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcauccaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153889 - RNA, 1701 nt, Artificial Sequence
  derived and/or modified sequence opt4 from hemagglutinin__InfluenzaA__ABJ09261
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguaccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153890 - RNA, 1701 nt, Artificial Sequence
  derived and/or modified sequence opt4 from hemagglutinin__InfluenzaA__ABJ09272
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgacggcuuccagaacaaggagugggaccuguucguggagagaagaaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaggacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153891 - RNA, 1701 nt, Artificial Sequence; identical to SEQ ID NO: 152592
  derived and/or modified sequence opt4 from hemagglutinin__InfluenzaA__ABJ09294

SEQ ID NO: 153892 - RNA, 1701 nt, Artificial Sequence
  derived and/or modified sequence opt4 from hemagglutinin__InfluenzaA__ABJ09305
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacgagaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153893 - RNA, 1701 nt, Artificial Sequence
  derived and/or modified sequence opt4 from hemagglutinin__InfluenzaA__ABJ09316
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacacugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153894 - RNA, 1701 nt, Artificial Sequence; identical to SEQ ID NO: 153170
  derived and/or modified sequence opt4 from hemagglutinin__InfluenzaA__ABJ09338

SEQ ID NO: 153895 - RNA, 1701 nt, Artificial Sequence
  derived and/or modified sequence opt4 from hemagglutinin__InfluenzaA__ABJ09349
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcugauccagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153896 - RNA, 1701 nt, Artificial Sequence; identical to SEQ ID NO: 153170
  derived and/or modified sequence opt4 from hemagglutinin__InfluenzaA__ABJ09360

SEQ ID NO: 153897 - RNA, 1701 nt, Artificial Sequence
  derived and/or modified sequence opt4 from hemagglutinin__InfluenzaA__ABJ09371
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacugagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153898 - RNA, 1701 nt, Artificial Sequence; identical to SEQ ID NO: 153153
  derived and/or modified sequence opt4 from hemagglutinin__InfluenzaA__ABJ09382

SEQ ID NO: 153899 - RNA, 1701 nt, Artificial Sequence
  derived and/or modified sequence opt4 from hemagglutinin__InfluenzaA__ABJ16587
augaagaccaucaucgcccugagcuacaucagcugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacagauaccccgcccugaacgugaccaugcccaacaacgacaaguucgacaagcuguacaucuggggcgugcaccaccccagcaccgacagcgaccagaccagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153900 - RNA, 1701 nt, Artificial Sequence
  derived and/or modified sequence opt4 from hemagglutinin__InfluenzaA__ABJ16598
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153901 - RNA, 1701 nt, Artificial Sequence
  derived and/or modified sequence opt4 from hemagglutinin__InfluenzaA__ABJ16620
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcaacagcccccaccagauccuggacggcgagaacugcacccugaucgacgcccugcugggcgacccccacugcgacggcuuccagaacaaggagugggaccuguucguggagagaaacaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacaagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153902 - RNA, 1701 nt, Artificial Sequence
  derived and/or modified sequence opt4 from hemagglutinin__InfluenzaA__ABJ16631
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaacagcagcuucuucagcagacugaacuggcugacccaccugaaguucaaguaccccgcccugaacgugaccaugcccaacaacgaggaguucgacaagcuguacaucuggggcgugcaccaccccggcaccuacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153903 - RNA, 1698 nt, Artificial Sequence
  derived and/or modified sequence opt4 from hemagglutinin__InfluenzaA__ABJ16664
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggccacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagagaaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153904 - RNA, 1698 nt, Artificial Sequence; identical to SEQ ID NO: 153724
  derived and/or modified sequence opt4 from hemagglutinin__InfluenzaA__ABJ16675

SEQ ID NO: 153905 - RNA, 1698 nt, Artificial Sequence
  derived and/or modified sequence opt4 from hemagglutinin__InfluenzaA__ABJ16686
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153906 - RNA, 1701 nt, Artificial Sequence
  derived and/or modified sequence opt4 from hemagglutinin__InfluenzaA__ABJ16697
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcgccgugcugcugggcuucaucaugugggccugccagaagggcaacaucagaugcaacaucugcaucuga

SEQ ID NO: 153907 - RNA, 1701 nt, Artificial Sequence
  derived and/or modified sequence opt4 from hemagglutinin__InfluenzaA__ABJ16730
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccagaagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153908 - RNA, 1701 nt, Artificial Sequence
  derived and/or modified sequence opt4 from hemagglutinin__InfluenzaA__ABJ16741
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagggcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcaucaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153909 - RNA, 1701 nt, Artificial Sequence
  derived and/or modified sequence opt4 from hemagglutinin__InfluenzaA__ABJ16752
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcggcaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153910 - RNA, 1701 nt, Artificial Sequence
  derived and/or modified sequence opt4 from hemagglutinin__InfluenzaA__ABJ16763
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacacugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153911 - RNA, 1701 nt, Artificial Sequence
  derived and/or modified sequence opt4 from hemagglutinin__InfluenzaA__ABJ16774
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagccccaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaaacggcaagagcagcaucaugagaagcaacacccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153912 - RNA, 1701 nt, Artificial Sequence
  derived and/or modified sequence opt4 from hemagglutinin__InfluenzaA__ABJ16785
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcuacgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153913 - RNA, 1701 nt, Artificial Sequence; identical to SEQ ID NO: 153430
  derived and/or modified sequence opt4 from hemagglutinin__InfluenzaA__ABJ53438

SEQ ID NO: 153914 - RNA, 1698 nt, Artificial Sequence; identical to SEQ ID NO: 153262
  derived and/or modified sequence opt4 from hemagglutinin__InfluenzaA__ABJ53449

SEQ ID NO: 153915 - RNA, 1701 nt, Artificial Sequence
  derived and/or modified sequence opt4 from hemagglutinin__InfluenzaA__ABJ53471
augaagaccaucaucgcccugagcuacauccugugccugguguucgcccagaagauccccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaggcagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153916 - RNA, 1701 nt, Artificial Sequence
  derived and/or modified sequence opt4 from hemagglutinin__InfluenzaA__ABJ53482
augaagaccaucaucgcccugagcuacauccugugccugguguucgcccagaagcugcccggcaacgacaacagcaccgccacccugugccugggccaccacgccgugcccaacggcaccaucgugagaaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153917 - RNA, 1698 nt, Artificial Sequence; identical to SEQ ID NO: 153752
  derived and/or modified sequence opt4 from hemagglutinin__InfluenzaA__ABJ53493

SEQ ID NO: 153918 - RNA, 1698 nt, Artificial Sequence
  derived and/or modified sequence opt4 from hemagglutinin__InfluenzaA__ABJ53504
augaaggccaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagagccugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccgagaagaacggccuguaccccaaccugagcaagagcuacgugaacaacaaggagaaggaggugcuggugcuguggggcgugcaccaccccagcaacaucggcgugcagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucgagagcggcaucaucaccagcaacgcccccaugaacgagugcgacgccaagugccagaccccccugggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153919 - RNA, 1701 nt, Artificial Sequence; identical to SEQ ID NO: 153907
  derived and/or modified sequence opt4 from hemagglutinin__InfluenzaA__ABJ53515

SEQ ID NO: 153920 - RNA, 1701 nt, Artificial Sequence
  derived and/or modified sequence opt4 from hemagglutinin__InfluenzaA__ABK39962
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaagacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153921 - RNA, 1701 nt, Artificial Sequence; identical to SEQ ID NO: 153150
  derived and/or modified sequence opt4 from hemagglutinin__InfluenzaA__ABK39973

SEQ ID NO: 153922 - RNA, 1701 nt, Artificial Sequence
  derived and/or modified sequence opt4 from hemagglutinin__InfluenzaA__ABK39984
augaagaccaucaucgcccugagcuacauccugugccugguguucgcccagaagcugcccggcaacgacaacagcagagccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucgaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153923 - RNA, 1698 nt, Artificial Sequence
  derived and/or modified sequence opt4 from hemagglutinin__InfluenzaA__ABK39995
augaaggugaagcugcugauccugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcgccugcuaccccggcuacuucgccgacuacgaggagcugagagagcagcugagcagcguguacagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcugauccuguggggcgugcaccacccccccaacaucggcaaccagagaacccuguaccacaccgagaacgccuacgugagcguggugagcagccacuacagcagaagauucacccccgagaucaccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggacagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153924 - RNA, 1701 nt, Artificial Sequence
  derived and/or modified sequence opt4 from hemagglutinin__InfluenzaA__ABK40017
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacaagaaguucgacaagcuguacaucuggggcgugcaccaccccggcaccgacaacgaccagaucagccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153925 - RNA, 1701 nt, Artificial Sequence
  derived and/or modified sequence opt4 from hemagglutinin__InfluenzaA__ABK40028
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugaccgugcugagcagccacuacagcagaagauucacccccgagaucgccagaagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153926 - RNA, 1701 nt, Artificial Sequence; identical to SEQ ID NO: 153907
  derived and/or modified sequence opt4 from hemagglutinin__InfluenzaA__ABK40039

SEQ ID NO: 153927 - RNA, 1701 nt, Artificial Sequence; identical to SEQ ID NO: 153907
  derived and/or modified sequence opt4 from hemagglutinin__InfluenzaA__ABK40050

SEQ ID NO: 153928 - RNA, 1701 nt, Artificial Sequence; identical to SEQ ID NO: 153170
  derived and/or modified sequence opt4 from hemagglutinin__InfluenzaA__ABK40061

SEQ ID NO: 153929 - RNA, 1701 nt, Artificial Sequence; identical to SEQ ID NO: 153170
  derived and/or modified sequence opt4 from hemagglutinin__InfluenzaA__ABK40075

SEQ ID NO: 153930 - RNA, 1701 nt, Artificial Sequence; identical to SEQ ID NO: 153441
  derived and/or modified sequence opt4 from hemagglutinin__InfluenzaA__ABK40510

SEQ ID NO: 153931 - RNA, 1701 nt, Artificial Sequence; identical to SEQ ID NO: 153441
  derived and/or modified sequence opt4 from hemagglutinin__InfluenzaA__ABK40534

SEQ ID NO: 153932 - RNA, 1701 nt, Artificial Sequence
  derived and/or modified sequence opt4 from hemagglutinin__InfluenzaA__ABK40546
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaacaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153933 - RNA, 1701 nt, Artificial Sequence; identical to SEQ ID NO: 153441
  derived and/or modified sequence opt4 from hemagglutinin__InfluenzaA__ABK40557

SEQ ID NO: 153934 - RNA, 1701 nt, Artificial Sequence; identical to SEQ ID NO: 153441
  derived and/or modified sequence opt4 from hemagglutinin__InfluenzaA__ABK40568

SEQ ID NO: 153935 - RNA, 1701 nt, Artificial Sequence; identical to SEQ ID NO: 153441
  derived and/or modified sequence opt4 from hemagglutinin__InfluenzaA__ABK40579

SEQ ID NO: 153936 - RNA, 1701 nt, Artificial Sequence
  derived and/or modified sequence opt4 from hemagglutinin__InfluenzaA__ABK40590
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153937 - RNA, 1701 nt, Artificial Sequence; identical to SEQ ID NO: 153441
  derived and/or modified sequence opt4 from hemagglutinin__InfluenzaA__ABK40601

SEQ ID NO: 153938 - RNA, 1701 nt, Artificial Sequence; identical to SEQ ID NO: 153170
  derived and/or modified sequence opt4 from hemagglutinin__InfluenzaA__ABK40612

SEQ ID NO: 153939 - RNA, 1701 nt, Artificial Sequence
  derived and/or modified sequence opt4 from hemagglutinin__InfluenzaA__ABK40623
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucgccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacgugaaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacgugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153940 - RNA, 1701 nt, Artificial Sequence; identical to SEQ ID NO: 153504
  derived and/or modified sequence opt4 from hemagglutinin__InfluenzaA__ABK40645

SEQ ID NO: 153941 - RNA, 1701 nt, Artificial Sequence
  derived and/or modified sequence opt4 from hemagglutinin__InfluenzaA__ABK40656
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagccccaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagaacuucaacuggaccggcguggcccaggacggcaagagcuacagcugcaagagaggcagcgugaacagcuucuucagcagacugaacuggcugcacaagcuggaguacaaguaccccgcccugaacgugaccaugcccaacaacggcaaguucgacaagcuguacaucuggggcgugcaccaccccagcaccgacagcgaccagaccagccuguacgugagagccagcggcaaggugaccgugagcaccaagagaagccagcagaccgugauccccgacaucggcuacagacccugggugagaggccugagcagcagaaucagcaucuacuggaccaucgugaagcccggcgacauccugcugaucaacagcaccggcaaccugaucgcccccagaggcuacuucaagaucagaaacggcaagagcagcaucaugagaagcgacgcccccaucggcaacugcagcagcgagugcaucacccccaacggcagcauccccaacgacaagcccuuccagaacgugaacagaaucaccuacggcaccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugguggagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153942 - RNA, 1701 nt, Artificial Sequence
  derived and/or modified sequence opt4 from hemagglutinin__InfluenzaA__ABK40667
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccacagaauccuggacggcaagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaccaacgagggcuucaacuggaccggcguggcccaggacggcaagagcuacgccugcaagagaggcagcgugaacagcuucuucagcagacugaacuggcugcacaagcuggaguacaaguaccccgcccugaacgugaccaugcccaacaacgacaaguucgacaagcuguacaucuggggcgugcaccaccccagcaccgacagcgaccagaccagccuguacgugcaggccagcggcagagugaccgugagcaccaagagaagccagcagaccgugauccccaacaucggcagcagacccugggugagaggcaucagcagcagaaucagcaucuacuggaccaucgugaagcccggcgacauccugcugaucaacagcaccggcaaccugaucgcccccagaggcuacuucaagcugagaaacggcaagagcagcaucaugagaagcgacgcccccaucgacaacugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucgaccagaucaacggcaagcugaacagacugaccgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugcuucaagaucuaccacaagugcgacaacgccugcaucggcagcaucagaaacggcaccuacaaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153943 - RNA, 1701 nt, Artificial Sequence; identical to SEQ ID NO: 153586
  derived and/or modified sequence opt4 from hemagglutinin__InfluenzaA__ABK40678

SEQ ID NO: 153944 - RNA, 1698 nt, Artificial Sequence
  derived and/or modified sequence opt4 from hemagglutinin__InfluenzaA__ABK40689
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcaaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153945 - RNA, 1701 nt, Artificial Sequence; identical to SEQ ID NO: 153170
  derived and/or modified sequence opt4 from hemagglutinin__InfluenzaA__ABK40700

SEQ ID NO: 153946 - RNA, 1701 nt, Artificial Sequence; identical to SEQ ID NO: 153170
  derived and/or modified sequence opt4 from hemagglutinin__InfluenzaA__ABK40711

SEQ ID NO: 153947 - RNA, 1701 nt, Artificial Sequence
  derived and/or modified sequence opt4 from hemagglutinin__InfluenzaA__ABK40722
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacaacgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153948 - RNA, 1701 nt, Artificial Sequence; identical to SEQ ID NO: 153170
  derived and/or modified sequence opt4 from hemagglutinin__InfluenzaA__ABK40733

SEQ ID NO: 153949 - RNA, 1701 nt, Artificial Sequence; identical to SEQ ID NO: 153825
  derived and/or modified sequence opt4 from hemagglutinin__InfluenzaA__ABK40744

SEQ ID NO: 153950 - RNA, 1701 nt, Artificial Sequence; identical to SEQ ID NO: 153435
  derived and/or modified sequence opt4 from hemagglutinin__InfluenzaA__ABK79948

SEQ ID NO: 153951 - RNA, 1698 nt, Artificial Sequence; identical to SEQ ID NO: 153724
  derived and/or modified sequence opt4 from hemagglutinin__InfluenzaA__ABK79959

SEQ ID NO: 153952 - RNA, 1701 nt, Artificial Sequence
  derived and/or modified sequence opt4 from hemagglutinin__InfluenzaA__ABK79970
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaagaagagcuggagcuacaucgccgagacccccaaccccaagaacggcaccugcuaccccggcuacuucgccgacuacgaggagcugagagagcagcugagcagcgugagcagcuucgagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccagaagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153953 - RNA, 1701 nt, Artificial Sequence
  derived and/or modified sequence opt4 from hemagglutinin__InfluenzaA__ABK79981
augaagaccaucaucgcccugagcuacauccugugccugguguucacccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153954 - RNA, 1701 nt, Artificial Sequence; identical to SEQ ID NO: 153170
  derived and/or modified sequence opt4 from hemagglutinin__InfluenzaA__ABK79992

SEQ ID NO: 153955 - RNA, 1701 nt, Artificial Sequence; identical to SEQ ID NO: 153441
  derived and/or modified sequence opt4 from hemagglutinin__InfluenzaA__ABK80025

SEQ ID NO: 153956 - RNA, 1701 nt, Artificial Sequence; identical to SEQ ID NO: 153441
  derived and/or modified sequence opt4 from hemagglutinin__InfluenzaA__ABK80036

SEQ ID NO: 153957 - RNA, 1701 nt, Artificial Sequence; identical to SEQ ID NO: 153441
  derived and/or modified sequence opt4 from hemagglutinin__InfluenzaA__ABK80047

SEQ ID NO: 153958 - RNA, 1701 nt, Artificial Sequence; identical to SEQ ID NO: 153286
  derived and/or modified sequence opt4 from hemagglutinin__InfluenzaA__ABK80058

SEQ ID NO: 153959 - RNA, 1701 nt, Artificial Sequence
  derived and/or modified sequence opt4 from hemagglutinin__InfluenzaA__ABK80069
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccuggaucagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucgccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccugaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacgugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153960 - RNA, 1701 nt, Artificial Sequence
  derived and/or modified sequence opt4 from hemagglutinin__InfluenzaA__ABK80080
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacaugggcaacggcugccugaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153961 - RNA, 1701 nt, Artificial Sequence; identical to SEQ ID NO: 153170
  derived and/or modified sequence opt4 from hemagglutinin__InfluenzaA__ABK80091

SEQ ID NO: 153962 - RNA, 1701 nt, Artificial Sequence; identical to SEQ ID NO: 153170
  derived and/or modified sequence opt4 from hemagglutinin__InfluenzaA__ABK80102

SEQ ID NO: 153963 - RNA, 1701 nt, Artificial Sequence; identical to SEQ ID NO: 152571
  derived and/or modified sequence opt4 from hemagglutinin__InfluenzaA__ABK80113

SEQ ID NO: 153964 - RNA, 1701 nt, Artificial Sequence
  derived and/or modified sequence opt4 from hemagglutinin__InfluenzaA__ABK80124
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcaucgugcugcugggcuucaucaugugggccugccagaagggcaacaucagaugcaacaucugcaucuga

SEQ ID NO: 153965 - RNA, 1701 nt, Artificial Sequence; identical to SEQ ID NO: 152571
  derived and/or modified sequence opt4 from hemagglutinin__InfluenzaA__ABK80135

SEQ ID NO: 153966 - RNA, 1701 nt, Artificial Sequence; identical to SEQ ID NO: 152571
  derived and/or modified sequence opt4 from hemagglutinin__InfluenzaA__ABK80146

SEQ ID NO: 153967 - RNA, 1701 nt, Artificial Sequence; identical to SEQ ID NO: 152571
  derived and/or modified sequence opt4 from hemagglutinin__InfluenzaA__ABK80157

SEQ ID NO: 153968 - RNA, 1701 nt, Artificial Sequence; identical to SEQ ID NO: 153082
  derived and/or modified sequence opt4 from hemagglutinin__InfluenzaA__ABK80168

SEQ ID NO: 153969 - RNA, 1701 nt, Artificial Sequence
  derived and/or modified sequence opt4 from hemagglutinin__InfluenzaA__ABK80179
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcgugcccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagacugcagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153970 - RNA, 1701 nt, Artificial Sequence; identical to SEQ ID NO: 153082
  derived and/or modified sequence opt4 from hemagglutinin__InfluenzaA__ABK80190

SEQ ID NO: 153971 - RNA, 1701 nt, Artificial Sequence; identical to SEQ ID NO: 153825
  derived and/or modified sequence opt4 from hemagglutinin__InfluenzaA__ABK80201

SEQ ID NO: 153972 - RNA, 1701 nt, Artificial Sequence
  derived and/or modified sequence opt4 from hemagglutinin__InfluenzaA__ABK80212
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaagaacuggauccuguggaucagcuucgccaucagcugcuuccugcugugcguggcccugcugggcuucaucaugugggccugccagaagggcaacaucagaugcaacaucugcaucuga

SEQ ID NO: 153973 - RNA, 1701 nt, Artificial Sequence; identical to SEQ ID NO: 153036
  derived and/or modified sequence opt4 from hemagglutinin__InfluenzaA__ABK80223

SEQ ID NO: 153974 - RNA, 1701 nt, Artificial Sequence
  derived and/or modified sequence opt4 from hemagglutinin__InfluenzaA__ABK80234
augagaaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153975 - RNA, 1701 nt, Artificial Sequence
  derived and/or modified sequence opt4 from hemagglutinin__InfluenzaA__ABK80245
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaaccagagcuucuucagcagacugaacuggcugacccaccugaaguucaaguaccccgcccugaacgugaccaugcccaacaacgagaaguucgacaagcuguacaucuggggcgugcaccaccccggcaccgacagcgaccagaucagccuguacgcccaggcccccggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaucagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 153976 - RNA, 1701 nt, Artificial Sequence; identical to SEQ ID NO: 153975
  derived and/or modified sequence opt4 from hemagglutinin__InfluenzaA__ABK80256

SEQ ID NO: 153977 - RNA, 1701 nt, Artificial Sequence; identical to SEQ ID NO: 153132
  derived and/or modified sequence opt4 from hemagglutinin__InfluenzaA__ABK80267

SEQ ID NO: 153978 - RNA, 1701 nt, Artificial Sequence; identical to SEQ ID NO: 153153
  derived and/or modified sequence opt4 from hemagglutinin__InfluenzaA__ABK80278

SEQ ID NO: 153979 - RNA, 1701 nt, Artificial Sequence
  derived and/or modified sequence opt4 from hemagglutinin__InfluenzaA__ABK80289
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153980 - RNA, 1701 nt, Artificial Sequence; identical to SEQ ID NO: 152571
  derived and/or modified sequence opt4 from hemagglutinin__InfluenzaA__ABK80300

SEQ ID NO: 153981 - RNA, 1701 nt, Artificial Sequence; identical to SEQ ID NO: 152571
  derived and/or modified sequence opt4 from hemagglutinin__InfluenzaA__ABK80311

SEQ ID NO: 153982 - RNA, 1707 nt, Artificial Sequence
  derived and/or modified sequence opt4 from hemagglutinin__InfluenzaA__ABL07019
auggagaagaucgugcugcugcugagcaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaccaagaagaacagcaccuaccccaccaucaagaagagcuacaacaacaccaaccaggaggaccugcuggugcuguggggcauccaccaccccaacaacgaggccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacagcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 153983 - RNA, 1707 nt, Artificial Sequence
  derived and/or modified sequence opt4 from hemagglutinin__InfluenzaA__ABL07030
auggagaagaucgugcugcugcuggccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucugggccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 153984 - RNA, 1707 nt, Artificial Sequence
  derived and/or modified sequence opt4 from hemagglutinin__InfluenzaA__ABL10088
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcgaggugaacggccagagcggcagaauggaguucuucuggaccauccugaagcccaacgacgccaucaacuucgagagcaacggcaacuucguggcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccaacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 153985 - RNA, 1707 nt, Artificial Sequence
  derived and/or modified sequence opt4 from hemagglutinin__InfluenzaA__ABL31766
auggagaagaucgugcugcugcuggccaucgugagcuucgugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacgacgccgccgagcagaccagacuguaccagaaccccaccaccuacaucagcaucggcaccagcacccugaaccagagacuggugcccaagaucgccaccagaagcaaggugaacggccagagcggcagaauggaguucuucugggccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 153986 - RNA, 1707 nt, Artificial Sequence
  derived and/or modified sequence opt4 from hemagglutinin__InfluenzaA__ABL31780
auggagaagaucgugcugcugcugagcaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagggcagcuggagcgaccacgaggccagcagcggcgugagcagcgccugccccuaccugagaagccccagcuucuucagaaacgugguguggcugaucaagaagaacagcaccuaccccaccaucaagaagagcuacaacaacaccaaccaggaggaccugcuggugcuguggggcauccaccaccccaacaacgaggccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 153987 - RNA, 1701 nt, Artificial Sequence
  derived and/or modified sequence opt4 from hemagglutinin__InfluenzaA__ABL67165
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccagcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagaagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 153988 - RNA, 1701 nt, Artificial Sequence
  derived and/or modified sequence opt4 from hemagglutinin__InfluenzaA__ABL67176
augaagaccaucaucgcccugagcuacauccugugccugguguucacccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcagagccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggcccccggcagagugaccgugagcaccaagagaagccagcagaccgugauccccaacaucggcagcagacccugggugagaggcgugagcagcagaaucagcaucuacuggaccaucgugaagcccggcgacauccugcugaucaacugcaccggcaaccugaucgcccccagaggcuacuucaagaucagaagcggcaagagcagcaucaugagaagcgacgccagcaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153989 - RNA, 1701 nt, Artificial Sequence; identical to SEQ ID NO: 153952
  derived and/or modified sequence opt4 from hemagglutinin__InfluenzaA__ABL67187

SEQ ID NO: 153990 - RNA, 1701 nt, Artificial Sequence; identical to SEQ ID NO: 153907
  derived and/or modified sequence opt4 from hemagglutinin__InfluenzaA__ABL67209

SEQ ID NO: 153991 - RNA, 1701 nt, Artificial Sequence; identical to SEQ ID NO: 153441
  derived and/or modified sequence opt4 from hemagglutinin__InfluenzaA__ABL67253

SEQ ID NO: 153992 - RNA, 1701 nt, Artificial Sequence
  derived and/or modified sequence opt4 from hemagglutinin__InfluenzaA__ABL67264
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacaaccacaacggcaagcugugcaagcugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaaaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagcuuccccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 153993 - RNA, 1701 nt, Artificial Sequence
  derived and/or modified sequence opt4 from hemagglutinin__InfluenzaA__ABL67275
augaagaccaucaucgcccugagcuacauccugugccugguguucgcccagaagcugcccgugaacgacaacagcaccgccacccugugccugggccaccacgccgugcccaacggcacccuggugaagaccaucaccaacgaccacaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaccgccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaucaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcaacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccagaaagcagcugagagagaacgccgaggacgugggcaacggcugcuucaagaucuaccacaagugcgacaacgccugcaucggcagcaucagaaacggcaccuacgaccacgacguguacagagacgaggcccugaacaacagauuccagaucaagggcgugaagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 153994 - RNA, 1701 nt, Artificial Sequence
  derived and/or modified sequence opt4 from hemagglutinin__InfluenzaA__ABL67286
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagagcggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 153995 - RNA, 1701 nt, Artificial Sequence; identical to SEQ ID NO: 153525
  derived and/or modified sequence opt4 from hemagglutinin__InfluenzaA__ABL67297

SEQ ID NO: 153996 - RNA, 1701 nt, Artificial Sequence
  derived and/or modified sequence opt4 from hemagglutinin__InfluenzaA__ABL67308
augaagaccaucaucgcccugagcuacauccugugccugguguucgcccagaagcugcccggcaacgacaacagcauggccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcagcugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcagacccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucgacaagugcaacagcgagugcaucacccccaacggcagcauccccaacgacaagcccuuccagaacgugaacagaaucaccuacggccugugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacgugagaugcaacaucugcaucuga

SEQ ID NO: 153997 - RNA, 1701 nt, Artificial Sequence; identical to SEQ ID NO: 153082
  derived and/or modified sequence opt4 from hemagglutinin__InfluenzaA__ABL67319

SEQ ID NO: 153998 - RNA, 1701 nt, Artificial Sequence; identical to SEQ ID NO: 153825
  derived and/or modified sequence opt4 from hemagglutinin__InfluenzaA__ABL67330

SEQ ID NO: 153999 - RNA, 1701 nt, Artificial Sequence; identical to SEQ ID NO: 153036
  derived and/or modified sequence opt4 from hemagglutinin__InfluenzaA__ABL67341

SEQ ID NO: 154000 - RNA, 1701 nt, Artificial Sequence; identical to SEQ ID NO: 153036
  derived and/or modified sequence opt4 from hemagglutinin__InfluenzaA__ABL67352

SEQ ID NO: 154001 - RNA, 1701 nt, Artificial Sequence; identical to SEQ ID NO: 152552
  derived and/or modified sequence opt4 from hemagglutinin__InfluenzaA__ABL67363

SEQ ID NO: 154002 - RNA, 1701 nt, Artificial Sequence
  derived and/or modified sequence opt4 from hemagglutinin__InfluenzaA__ABL67374
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggcccacagcaacugcuaccccuacgacgugcccgacuacgccagccugagaagccugaucgccagcagcggcacccuggaguucaacaacgagagcuucaacuggaccggcgugacccagaacggcaccagcagcgccugcaagagaagaagcaaccagagcuucuucagcagacugaacuggcugacccaccugaaguucaaguaccccgcccugaacgugaccaugcccaacaacgagaaguucgacaagcuguacaucuggggcgugcaccaccccggcaccgacagcgaccagaucagccuguacgcccaggcccccggcagaaucaccgugagcaccaagagaagccagcagaccgugauccccaacaucggcagcagacccagagugagagacaucagcagcagaaucagcaucuacuggaccaucgugaagcccggcgacauccugcugaucaacagcaccggcaaccugaucgcccccagaggcuacuucaagaugagaagcggcaagagcagcaucaugaagagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcgacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugccugcugcugugcguggcccugcugggcuucaucaugugggccugccagaagggcaacaucagaugcaacaucugcaucuga

SEQ ID NO: 154003 - RNA, 1701 nt, Artificial Sequence; identical to SEQ ID NO: 152802
  derived and/or modified sequence opt4 from hemagglutinin__InfluenzaA__ABL67385

SEQ ID NO: 154004 - RNA, 1701 nt, Artificial Sequence; identical to SEQ ID NO: 153132
  derived and/or modified sequence opt4 from hemagglutinin__InfluenzaA__ABL67396

SEQ ID NO: 154005 - RNA, 1701 nt, Artificial Sequence; identical to SEQ ID NO: 153150
  derived and/or modified sequence opt4 from hemagglutinin__InfluenzaA__ABL67407

SEQ ID NO: 154006 - RNA, 1701 nt, Artificial Sequence
  derived and/or modified sequence opt4 from hemagglutinin__InfluenzaA__ABL67418
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcaacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154007 - RNA, 1707 nt, Artificial Sequence; identical to SEQ ID NO: 152548
  derived and/or modified sequence opt4 from hemagglutinin__InfluenzaA__ABL67781

SEQ ID NO: 154008 - RNA, 1707 nt, Artificial Sequence
  derived and/or modified sequence opt4 from hemagglutinin__InfluenzaA__ABL67794
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagaagagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 154009 - RNA, 1707 nt, Artificial Sequence
  derived and/or modified sequence opt4 from hemagglutinin__InfluenzaA__ABL67816
auggagaagaucgugcugcuguucgccaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagaagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 154010 - RNA, 1707 nt, Artificial Sequence
  derived and/or modified sequence opt4 from hemagglutinin__InfluenzaA__ABL67827
auggagaagaucgugcugcuguucgccaucgugagccuggugaagagcgaccacaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccgugaacgaccugugcuaccccggcgacuucaacgacuacgaggagcugaagcaccugcugagcagaaucaaccacuucgagaagauccagaucauccccaagagcagcuggagcagccacgaggccagccugggcgugagcagcgccugccccuaccagggcaagagcagcuucuucagaaacgugguguggcugaucaagaagaacagcaccuaccccaccaucaagagaagcuacaacaacaccaaccaggaggaccugcuggugcuguggggcauccaccaccccaacgacgccgccgagcagaccaagcuguaccagaaccccaccaccuacaucagcgugggcaccagcacccugaaccagagacuggugcccagaaucgccaccagaagcaaggugaacggccagagcggcagaauggaguucuucuggaccauccugaagcccaacgacgccaucaacuucgagagcaacggcaacuucaucgcccccgaguacgccuacgagaucgugaagaagggcgacagcaccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagaucgagagaagaagaaagaagagaggccuguucggcgccaucgccggcuuccuggagggcggcuggcagggcaugguggacggcugguacggcuaccaccacagcaacgagcagggcagcggcuacgccgccgacaaggagagcacccagaaggccaucgacggcgugaccaacaaggugaacagcaucaucaacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcgugagaaacggcaccuacgacuacccccaguacagcgaggaggccagacugaagagagaggagaucagcggcgugaagcuggagagcaucggcaucuaccagauccugagcaucuacagcaccguggccagcagccuggcccuggccaucaugguggccggccugagccuguggaugugcagcaacggcagccugcagugcagaaucugcaucuga

SEQ ID NO: 154011 - RNA, 1701 nt, Artificial Sequence
  derived and/or modified sequence opt4 from hemagglutinin__InfluenzaA__ABM22015
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcgacaucugcaucuga

SEQ ID NO: 154012 - RNA, 1701 nt, Artificial Sequence
  derived and/or modified sequence opt4 from hemagglutinin__InfluenzaA__ABM22026
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcaucgccggcuggauccugggcaaccccgagugcgagagccuguucagcaaggagagcuggagcuacaucgccgagacccccaaccccaagaacggcaccugcuaccccggcuacuucgccgacuacgaggagcugagagagcagcugagcagcgugagcagcuucaagagauucgagaucuuccccaaggacagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaagaagggcaaggaggugcuggugcuguggggcgugcaccaccccagcaacaugggcgaccagagagccaucuaccacaaggagaacgccuacgugagcgugcugagcagccacuacagcagaagauucacccccgagaucgccagaagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaucagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacgugcccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcaucaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcaaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154013 - RNA, 1701 nt, Artificial Sequence; identical to SEQ ID NO: 153153
  derived and/or modified sequence opt4 from hemagglutinin__InfluenzaA__ABM22037

SEQ ID NO: 154014 - RNA, 1701 nt, Artificial Sequence; identical to SEQ ID NO: 152571
  derived and/or modified sequence opt4 from hemagglutinin__InfluenzaA__ABM22059

SEQ ID NO: 154015 - RNA, 1701 nt, Artificial Sequence; identical to SEQ ID NO: 153825
  derived and/or modified sequence opt4 from hemagglutinin__InfluenzaA__ABM22070

SEQ ID NO: 154016 - RNA, 1701 nt, Artificial Sequence
  derived and/or modified sequence opt4 from hemagglutinin__InfluenzaA__ABM22081
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacuggaccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacauccccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154017 - RNA, 1701 nt, Artificial Sequence
  derived and/or modified sequence opt4 from hemagglutinin__InfluenzaA__ABM22092
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgaccacgccagccugagaagccugguggccagcagcggcacccuggaguucaacaacgagagcuucgacugggccggcgugacccagaacggcaccagcagcgccugcaagagaagaagcaacaagagcuucuucagcagacugaacuggcugacccaccugaaguacaaguaccccgcccugaacgugaccaugcccaacaacgagaaguucgacaagcuguacaucuggggcgugcaccaccccggcaccgacagcgaccagaucagccuguacgcccaggccagcggcagaaucaccgugagcaccaagagaagccagcagaccgugauccccaacaucggcagcagacccagagugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154018 - RNA, 1701 nt, Artificial Sequence; identical to SEQ ID NO: 153830
  derived and/or modified sequence opt4 from hemagglutinin__InfluenzaA__ABM22103

SEQ ID NO: 154019 - RNA, 1701 nt, Artificial Sequence; identical to SEQ ID NO: 153036
  derived and/or modified sequence opt4 from hemagglutinin__InfluenzaA__ABM22114

SEQ ID NO: 154020 - RNA, 1701 nt, Artificial Sequence; identical to SEQ ID NO: 153975
  derived and/or modified sequence opt4 from hemagglutinin__InfluenzaA__ABM22125

SEQ ID NO: 154021 - RNA, 1701 nt, Artificial Sequence
  derived and/or modified sequence opt4 from hemagglutinin__InfluenzaA__ABM22136
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaucggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154022 - RNA, 1701 nt, Artificial Sequence; identical to SEQ ID NO: 153153
  derived and/or modified sequence opt4 from hemagglutinin__InfluenzaA__ABM22147

SEQ ID NO: 154023 - RNA, 1701 nt, Artificial Sequence; identical to SEQ ID NO: 153441
  derived and/or modified sequence opt4 from hemagglutinin__InfluenzaA__ABM22158

SEQ ID NO: 154024 - RNA, 1701 nt, Artificial Sequence; identical to SEQ ID NO: 153441
  derived and/or modified sequence opt4 from hemagglutinin__InfluenzaA__ABM22169

SEQ ID NO: 154025 - RNA, 1701 nt, Artificial Sequence; identical to SEQ ID NO: 153441
  derived and/or modified sequence opt4 from hemagglutinin__InfluenzaA__ABM22180

SEQ ID NO: 154026 - RNA, 1701 nt, Artificial Sequence; identical to SEQ ID NO: 153441
  derived and/or modified sequence opt4 from hemagglutinin__InfluenzaA__ABM22191

SEQ ID NO: 154027 - RNA, 1701 nt, Artificial Sequence; identical to SEQ ID NO: 153441
  derived and/or modified sequence opt4 from hemagglutinin__InfluenzaA__ABM22202

SEQ ID NO: 154028 - RNA, 1701 nt, Artificial Sequence; identical to SEQ ID NO: 153441
  derived and/or modified sequence opt4 from hemagglutinin__InfluenzaA__ABM22213

SEQ ID NO: 154029 - RNA, 1701 nt, Artificial Sequence; identical to SEQ ID NO: 153441
  derived and/or modified sequence opt4 from hemagglutinin__InfluenzaA__ABM22224

SEQ ID NO: 154030 - RNA, 1701 nt, Artificial Sequence; identical to SEQ ID NO: 153441
  derived and/or modified sequence opt4 from hemagglutinin__InfluenzaA__ABM22235

SEQ ID NO: 154031 - RNA, 1701 nt, Artificial Sequence
  derived and/or modified sequence opt4 from hemagglutinin__InfluenzaA__ABM22268
augaaggugaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154032 - RNA, 1701 nt, Artificial Sequence
  derived and/or modified sequence opt4 from hemagglutinin__InfluenzaA__ABM22279
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagacacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgacugcgacgccaagugccagaccccccagggcgccaucaacagcagccugcccuuccagaacgugcaccccgugaccaucggcggcugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuaccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154033 - RNA, 1701 nt, Artificial Sequence
  derived and/or modified sequence opt4 from hemagglutinin__InfluenzaA__ABM22290
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggagaacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154034 - RNA, 1701 nt, Artificial Sequence; identical to SEQ ID NO: 152775
  derived and/or modified sequence opt4 from hemagglutinin__InfluenzaA__ABM22301

SEQ ID NO: 154035 - RNA, 1701 nt, Artificial Sequence; identical to SEQ ID NO: 152775
  derived and/or modified sequence opt4 from hemagglutinin__InfluenzaA__ABM22312

SEQ ID NO: 154036 - RNA, 1701 nt, Artificial Sequence; identical to SEQ ID NO: 152775
  derived and/or modified sequence opt4 from hemagglutinin__InfluenzaA__ABM22323

SEQ ID NO: 154037 - RNA, 1701 nt, Artificial Sequence; identical to SEQ ID NO: 152775
  derived and/or modified sequence opt4 from hemagglutinin__InfluenzaA__ABM22334

SEQ ID NO: 154038 - RNA, 1701 nt, Artificial Sequence; identical to SEQ ID NO: 152776
  derived and/or modified sequence opt4 from hemagglutinin__InfluenzaA__ABM22345

SEQ ID NO: 154039 - RNA, 1701 nt, Artificial Sequence; identical to SEQ ID NO: 152776
  derived and/or modified sequence opt4 from hemagglutinin__InfluenzaA__ABM22356

SEQ ID NO: 154040 - RNA, 1701 nt, Artificial Sequence; identical to SEQ ID NO: 152776
  derived and/or modified sequence opt4 from hemagglutinin__InfluenzaA__ABM22367

SEQ ID NO: 154041 - RNA, 1698 nt, Artificial Sequence; identical to SEQ ID NO: 153361
  derived and/or modified sequence opt4 from hemagglutinin__InfluenzaA__ABM66864

SEQ ID NO: 154042 - RNA, 1701 nt, Artificial Sequence; identical to SEQ ID NO: 153441
  derived and/or modified sequence opt4 from hemagglutinin__InfluenzaA__ABM66886

SEQ ID NO: 154043 - RNA, 1701 nt, Artificial Sequence; identical to SEQ ID NO: 153441
  derived and/or modified sequence opt4 from hemagglutinin__InfluenzaA__ABM66897

SEQ ID NO: 154044 - RNA, 1701 nt, Artificial Sequence; identical to SEQ ID NO: 153441
  derived and/or modified sequence opt4 from hemagglutinin__InfluenzaA__ABM66908

SEQ ID NO: 154045 - RNA, 1701 nt, Artificial Sequence; identical to SEQ ID NO: 152776
  derived and/or modified sequence opt4 from hemagglutinin__InfluenzaA__ABM66919

SEQ ID NO: 154046 - RNA, 1701 nt, Artificial Sequence; identical to SEQ ID NO: 152776
  derived and/or modified sequence opt4 from hemagglutinin__InfluenzaA__ABM66930

SEQ ID NO: 154047 - RNA, 1701 nt, Artificial Sequence; identical to SEQ ID NO: 152776
  derived and/or modified sequence opt4 from hemagglutinin__InfluenzaA__ABM66941

SEQ ID NO: 154048 - RNA, 1701 nt, Artificial Sequence; identical to SEQ ID NO: 152776
  derived and/or modified sequence opt4 from hemagglutinin__InfluenzaA__ABM66952

SEQ ID NO: 154049 - RNA, 1701 nt, Artificial Sequence; identical to SEQ ID NO: 152776
  derived and/or modified sequence opt4 from hemagglutinin__InfluenzaA__ABM66963

SEQ ID NO: 154050 - RNA, 1701 nt, Artificial Sequence; identical to SEQ ID NO: 152776
  derived and/or modified sequence opt4 from hemagglutinin__InfluenzaA__ABM66974

SEQ ID NO: 154051 - RNA, 1701 nt, Artificial Sequence; identical to SEQ ID NO: 152776
  derived and/or modified sequence opt4 from hemagglutinin__InfluenzaA__ABM66985

SEQ ID NO: 154052 - RNA, 1701 nt, Artificial Sequence; identical to SEQ ID NO: 152776
  derived and/or modified sequence opt4 from hemagglutinin__InfluenzaA__ABM66996

SEQ ID NO: 154053 - RNA, 1701 nt, Artificial Sequence; identical to SEQ ID NO: 152776
  derived and/or modified sequence opt4 from hemagglutinin__InfluenzaA__ABM67007

SEQ ID NO: 154054 - RNA, 1701 nt, Artificial Sequence; identical to SEQ ID NO: 152776
  derived and/or modified sequence opt4 from hemagglutinin__InfluenzaA__ABM67018

SEQ ID NO: 154055 - RNA, 1701 nt, Artificial Sequence
  derived and/or modified sequence opt4 from hemagglutinin__InfluenzaA__ABM67029
augaagaccaucaucgcccugagcuacaucaucugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154056 - RNA, 1698 nt, Artificial Sequence; identical to SEQ ID NO: 152819
  derived and/or modified sequence opt4 from hemagglutinin__InfluenzaA__ABM67051

SEQ ID NO: 154057 - RNA, 1707 nt, Artificial Sequence
  derived and/or modified sequence opt4 from hemagglutinin__InfluenzaA__ABM90467
auggagaagaucgugcugcugcugagcaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugagagacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacaacgaggccgagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacggcaacugcaacaccaagugccagacccccaugggcgccaucaacagcagcaugcccuuccacaacauccacccccugaccaucggcgagugccccaaguacgugaagagcaacagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154058 - RNA, 1707 nt, Artificial Sequence
  derived and/or modified sequence opt4 from hemagglutinin__InfluenzaA__ABM90511
auggagaagaucgugcugcugcugagcaucgugagccuggugaagagcgaccagaucugcaucggcuaccacgccaacaacagcaccgagcagguggacaccaucaucgagaagaacgugaccgugacccacgcccaggacauccuggagaagacccacaacggcaagcugugcgaccuggacggcgugaagccccugauccugaaggacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacaacgaggaggagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacagcaacugcaacaccaagugccagacccccaugggcgccaucaacagcagcaugcccuuccacaacauccacccccugaccaucggcgagugccccaaguacgugaagagcagcagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154059 - RNA, 1707 nt, Artificial Sequence
  derived and/or modified sequence opt4 from hemagglutinin__InfluenzaA__ABM90533
auggagaagaucgugcugcugcugagcaucgugagccuggugaagagcgaccagaucugcaucggcuaccacgccaacaacagcaccgagcagguggacaccaucauggagaagaacgugaccgugacccacgcccaggacauccuggagaagacccacaacggcaagcugugcgaccuggacggcgugaagccccugauccugaaggacugcagcguggccggcuggcugcugggcaaccccaugugcgacgaguucaucaacgugcccgaguggagcuacaucguggagaaggccaaccccaccaacgaccugugcuaccccggcagcuucaacgacuacgaggagcugaagcaccugcugagcagaaucaaccacuucgagaagauccagaucauccccaagagcagcuggagcgaccacgaggccagcagcggcgugagcagcgccugccccuaccugggcagccccagcuucuucagaaacgugguguggcugaucaagaagaacagcaccuaccccaccaucaagaagagcuacaacaacaccaaccaggaggaccugcuggugcuguggggcauccaccaccccaacaacgaggaggagcagaccagacuguaccagaaccccaccaccuacaucagcaucggcaccagcacccugaaccagagacuggugcccaagaucgccaccagaagcaaggugaacggccagagcggcagaauggaguucuucuggaccauccugaagcccaacgacgccaucaacuucgagagcaacggcaacuucaucgcccccgaguacgccuacaagaucgugaagaagggcgacagcgccaucaugaagagcgagcuggaguacagcaacugcaacaccaagugccagacccccaugggcgccaucaacagcagcaugcccuuccacaacauccacccccugaccaucggcgagugccccaaguacgugaagagcagcagacuggugcuggccaccggccugagaaacagcccccagagagagagcagaagaaagaagagaggccuguucggcgccaucgccggcuucaucgagggcggcuggcagggcaugguggacggcugguacggcuaccaccacagcaacgagcagggcagcggcuacgccgccgacaaggagagcacccagaaggccaucgacggcgugaccaacaaggugaacagcaucaucgacaagaugaacacccaguucgaggccgugggcagagaguucaacaaccuggagagaagaaucgagaaccugaacaagaagauggaggacggcuuccuggacguguggaccuacaacgccgagcugcuggugcugauggagaacgagagaacccuggacuuccacgacagcaacgugaagaaccuguacgacaaggugagacugcagcugagagacaacgccaaggagcugggcaacggcugcuucgaguucuaccacaagugcgacaacgagugcauggagagcaucagaaacggcaccuacaacuacccccaguacagcgaggaggccagacugaagagagaggagaucagcggcgugaagcuggagagcaucggcaccuaccagauccugagcaucuacagcaccguggccagcagccuggcccuggccaucaugaucgccggccugagccuguggaugugcagcaacggcagccugcagugcagaaucugcaucuga

SEQ ID NO: 154060 - RNA, 1707 nt, Artificial Sequence; identical to SEQ ID NO: 154059
  derived and/or modified sequence opt4 from hemagglutinin__InfluenzaA__ABM90544

SEQ ID NO: 154061 - RNA, 1701 nt, Artificial Sequence
  derived and/or modified sequence opt4 from hemagglutinin__InfluenzaA__ABN50900
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgaggaccagaagaccaucuacagaaaggagaacgccuacgugagcguggugagcagccacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154062 - RNA, 1701 nt, Artificial Sequence; identical to SEQ ID NO: 153441
  derived and/or modified sequence opt4 from hemagglutinin__InfluenzaA__ABN50917

SEQ ID NO: 154063 - RNA, 1701 nt, Artificial Sequence
  derived and/or modified sequence opt4 from hemagglutinin__InfluenzaA__ABN50928
augaaggccaagcugcugauccugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagaggccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154064 - RNA, 1701 nt, Artificial Sequence
  derived and/or modified sequence opt4 from hemagglutinin__InfluenzaA__ABN50940
augaaggccaagcugcuggugcugcugugcgccuucaccgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaacugcagcaucgccggcuggauccugggcaaccccgagugcgagagccuguucagcaagaagagcuggagcuacaucgccgagacccccaacagcgagaacggcaccugcuaccccggcuacuucagcgacuacgaggagcugagagagcagcugagcagcgugagcagcuucgagagauucgagaucuuccccaaggagagcagcuggcccaaccacaccgugaccaagggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacaacagaagauucacccccgagaucgccaagagacccaaggugagagaccaggagggcagaaucaacuacuacuggacccugcuggagcccgaggacaccaucaucuucgaggccaacggcaaccugaucgcccccugguacgccuucgcccugagcagaggcuucggcagcggcaucaucaccagcaacgccagcauggacgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154065 - RNA, 1701 nt, Artificial Sequence; identical to SEQ ID NO: 154031
  derived and/or modified sequence opt4 from hemagglutinin__InfluenzaA__ABN50951

SEQ ID NO: 154066 - RNA, 1701 nt, Artificial Sequence
  derived and/or modified sequence opt4 from hemagglutinin__InfluenzaA__ABN50962
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagagccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgagugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcauggagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154067 - RNA, 1701 nt, Artificial Sequence; identical to SEQ ID NO: 153430
  derived and/or modified sequence opt4 from hemagglutinin__InfluenzaA__ABN50973

SEQ ID NO: 154068 - RNA, 1701 nt, Artificial Sequence; identical to SEQ ID NO: 152775
  derived and/or modified sequence opt4 from hemagglutinin__InfluenzaA__ABN50984

SEQ ID NO: 154069 - RNA, 1701 nt, Artificial Sequence; identical to SEQ ID NO: 152776
  derived and/or modified sequence opt4 from hemagglutinin__InfluenzaA__ABN50995

SEQ ID NO: 154070 - RNA, 1701 nt, Artificial Sequence
  derived and/or modified sequence opt4 from hemagglutinin__InfluenzaA__ABN51043
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagagacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154071 - RNA, 1701 nt, Artificial Sequence; identical to SEQ ID NO: 153916
  derived and/or modified sequence opt4 from hemagglutinin__InfluenzaA__ABN51054

SEQ ID NO: 154072 - RNA, 1701 nt, Artificial Sequence
  derived and/or modified sequence opt4 from hemagglutinin__InfluenzaA__ABN51066
augaaggccaagcugcuggugcugcugugcgccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaccgccccccugcagcugggcaacugcagcguggccggcuggauccugggcaaccccgagugcgagagccuguucagcaaggagagcuggagcuacaucgccgagacccccaaccccgagaacggcaccugcuaccccggcuacuucgccgacuacgaggagcugagagagcagcugagcagcgugagcagcuucgagagauucgagaucuuccccaagaagagcagcuggcccaaccacaccgugaccaagggcgugaccgccagcugcagccacaacggcaagagcagcuucuacaagaaccugcuguggcugaccgagaagaacggccuguaccccaaccugagcaagagcuacgugaacaacaaggagaaggaggugcuggugcuguggggcgugcaccaccccagcaacaucggcgaccagagaaccaucuaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcaugggcgacugcgacgccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgacaagaagagcacccagaacgccaucgacggcaucaccaacaaggugaacagcgugaucgagaagaugaacacccaguucaccgccgugggcaaggaguucaacaagcuggagagaagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagaaccagcugaagaacaacgccaaggagaucggcaacggcugcuucgaguucuaccacaagugcaacaacgagugcaucgagagcgugaagaacggcaccuacgacuaccccaaguacagcgaggagagcaagcugaagagagagaagaucgacggcgugaagcuggagagcaugggcguguaccagauccuggccaucuacagcaccguggccagcagccuggugcugcuggugagccugggcgccaucggcuucuggaugugcagcaacggcagccugcagugcagaaucugcaucuga

SEQ ID NO: 154073 - RNA, 1698 nt, Artificial Sequence; identical to SEQ ID NO: 152816
  derived and/or modified sequence opt4 from hemagglutinin__InfluenzaA__ABN51077

SEQ ID NO: 154074 - RNA, 1698 nt, Artificial Sequence; identical to SEQ ID NO: 152819
  derived and/or modified sequence opt4 from hemagglutinin__InfluenzaA__ABN51088

SEQ ID NO: 154075 - RNA, 1701 nt, Artificial Sequence
  derived and/or modified sequence opt4 from hemagglutinin__InfluenzaA__ABN51099
augaagaccaucaucgcccugagcuacaucuucugccuggcccugggccaggaccugcccggcaacgacaacagcaccgccacccugugccugggccaccacgccgugcccaacggcacccuggugaagaccaucaccaacgaccagaucgaggugaccaacgccaccgagcuggugcagagcagcagcaccggcaagaucugcaacaacccccacagaauccuggacggcaucgacugcacccugaucgacgcccugcugggcgacccccacugcgacguguuccagaacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaugaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154076 - RNA, 1701 nt, Artificial Sequence
  derived and/or modified sequence opt4 from hemagglutinin__InfluenzaA__ABN51110
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154077 - RNA, 1701 nt, Artificial Sequence
  derived and/or modified sequence opt4 from hemagglutinin__InfluenzaA__ABN51121
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgcccccaucgacaccugcaucagcgagugcaucacccccaacggcagcauccccaacgacaagcccuuccagaacgugaacaagaucaccuacggcaccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgaccuggagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154078 - RNA, 1701 nt, Artificial Sequence
  derived and/or modified sequence opt4 from hemagglutinin__InfluenzaA__ABN51132
augaagaccaucaucgcccugagcuacaucuucugccuggcccugggccaggaccugcccggcaacgacaacagcaccgccacccugugccugggccaccacgccgugcccaacggcacccuggugaagaccaucaccgacgaccagaucgaggugaccaacgccaccgagcuggugcagagcagcagcaccggcaagaucugcaacaacccccacagaauccuggacggcaucaacugcacccugaucgacgcccugcugggcgacccccacugcgacguguuccaggacgagaccugggaccuguucguggagagaagcaaggccuucagcaacugcuaccccuacgacgugcccgacuacgccagccugagaagccugguggccagcagcggcacccuggaguucaucaccgagggcuucaccuggaccggcgugacccagaacggcggcagcaacgccugcaagagaggccccggcagcggcuucuucagcagacugaacuggcugaccaagagcggcagcaccuaccccgugcugaacgugaccaugcccaacaacgacaacuucgacaagcuguacaucuggggcgugcaccaccccagcaccaaccaggagcagaccagccuguacgugcaggccagcggcagagugaccgugagcaccagaagaagccagcagaccaucauccccaacaucggcagcagacccugggugagaggccugagcagcagaaucagcaucuacuggaccaucgugaagcccggcgacgugcuggugaucaacagcaacggcaaccugaucgcccccagaggcuacuucaagaugagaaccggcaagagcagcaucaugagaagcgacgccagcaucgacaccugcaucagcgagugcaucacccccaacggcagcauccccaacgacaagcccuuccagaacgugaacaagaucaccuacggcgccugccccaaguacgugaagcagaacacccugaagcuggccaccggcaugagaaacgugcccgagaagcagaccagaggccuguucggcgccaucgccggcuucaucgagaacggcugggagggcaugaucgacggcugguacggcuucagacaccagaacagcgagggcaccggccaggccgccgaccugaagagcacccaggccgccaucgaccagaucaacggcaagcugaacagagugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagaagaccagaagacagcugagagagaacgccgaggacaugggcaacggcugcuucaagaucuaccacaagugcgacaacgccugcaucgagagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagagaggcaacaucagaugcaacaucugcaucuga

SEQ ID NO: 154079 - RNA, 1698 nt, Artificial Sequence; identical to SEQ ID NO: 153320
  derived and/or modified sequence opt4 from hemagglutinin__InfluenzaA__ABN51143

SEQ ID NO: 154080 - RNA, 1701 nt, Artificial Sequence
  derived and/or modified sequence opt4 from hemagglutinin__InfluenzaA__ABN51154
augaagaccaucaucgcccugagcuacauccugugccugguguucacccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcagaaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgugagccugagaagccugguggccagcagcggcacccuggaguucaacaacgagagcuucaacuggaccggcguggcccagaacggcaccagcagcgccugcaagagaagaagcgacaagagcuucuucagcagacugaacuggcugcaccagcugaaguacaaguaccccgcccugaacgugaccaugcccaacaacgagaaguucgacaagcuguacaucuggggcgugcaccaccccggcaccgacagcgaccagaucagccuguacgcccaggccagcggcagagugaccgugagcaccaagagaagccagcagaccgugauccccaacaucggcagcggccccugggugagaggcgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggccccugccccagauacgugaagcagaacacccugaagcuggccaccggcaugagaaacgugcccgagaagcagaccagaggcaucuucggcgccaucgccggcuucaucgagaacggcugggagggcaugauggacggcugguacggcuucagacaccagaacagcgagggcaccggccaggccgccgaccugaagagcacccaggccgccaucaaccagaucaacggcaagcugaacagacugaucgagaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcaucgugcugcugggcuucaucaugugggccugccagaagggcaacaucagaugcaacaucugcaucuga

SEQ ID NO: 154081 - RNA, 1701 nt, Artificial Sequence
  derived and/or modified sequence opt4 from hemagglutinin__InfluenzaA__ABN59390
augaagaccaucaucgcccugagcuacaucaucugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcgagaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucagaaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggcccugcugggcuucaucaugugggccugccagaagggcaacaucagaugcaacaucugcaucuga

SEQ ID NO: 154082 - RNA, 1701 nt, Artificial Sequence
  derived and/or modified sequence opt4 from hemagglutinin__InfluenzaA__ABN59401
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacaucaccagaggcgugaccgccgccugcagccacaagggcaagagcagcuucuacagaaaccugcuguggcugaccgagaagaacggcagcuaccccaaccugaacaagagcuacgugaacaacaaggagaaggaggugcuggugcuguggggcgugcaccaccccagcaacaucgaggaccagaagacccuguacagaaaggagaacgccuacgugagcguggugagcagcaacuacaacagaagauucacccccgagaucgccgagagacccaaggugagaggccaggccggcagaaucaacuacuacuggacccugcuggagcccggcgacaccaucaucuucgaggccaacggcaaccugaucgcccccuggcacgccuucgcccugagcagaggcuucggcagcggcaucaucaccagcaacgccagcauggacgagugcgacaccaagugccagaccccccagggcgccaucaacagcagccugcccuuccagaacauccaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154083 - RNA, 1698 nt, Artificial Sequence
  derived and/or modified sequence opt4 from hemagglutinin__InfluenzaA__ABN59412
augaaggccaaccugcuggugcugcugugcgcccuggccgccgccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcaacaucgccggcuggcugcugggcaaccccgagugcgacccccugcugcccgugagaagcuggagcuacaucguggagacccccaacagcgagaacggcaucugcuaccccggcgacuucaucgacuacgaggagcugagagagcagcugagcagcgugagcagcuucgagagauucgagaucuuccccaaggagagcagcuggcccaaccacaacaccaacggcgugaccgccgccugcagccacgagggcaagagcagcuucuacagaaaccugcuguggcugaccgagaaggagggcagcuaccccaagcugaagaacagcuacgugaacaagaagggcaaggaggugcuggugcuguggggcauccaccacccccccaacagcaaggagcagcagaaccuguaccagaacgagaacgccuacgugagcguggugaccagcaacuacaacagaagauucacccccgagaucgccgagagacccaaggugagagaccaggccggcagaaugaacuacuacuggacccugcugaagcccggcgacaccaucaucuucgaggccaacggcaaccugaucgcccccauguacgccuucgcccugagcagaggcuucggcagcggcaucaucaccagcaacgccagcaugcacgagugcaacaccaagugccagaccccccugggcgccaucaacagcagccugcccuaccagaacauccaccccgugaccaucggcgagugccccaaguacgugagaagcgccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacaccgugaucgagaagaugaacauccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggaguuccacgacagcaacgugaagaaccuguacgagaaggugaagagccagcugaagaacaacgccaaggagaucggcaacggcugcuucgaguucuaccacaagugcgacaacgagugcauggagagcgugagaaacggcaccuacgacuaccccaaguacagcgaggagagcaagcugaacagagagaagguggacggcgugaagcuggagagcaugggcaucuaccagauccuggccaucuacagcaccguggccagcagccuggugcugcuggugagccugggcgccaucagcuucuggaugugcagcaacggcagccugcagugcagaaucugcaucuga

SEQ ID NO: 154084 - RNA, 1701 nt, Artificial Sequence
  derived and/or modified sequence opt4 from hemagglutinin__InfluenzaA__ABN59423
augaaggccaagcugcuggugcugcugugcgcccugagcgccaccgacgccgacaccaucugcaucggcuaccacgccaacaacagcaccgacaccguggacaccgugcuggagaagaacgugaccgugacccacagcgugaaccugcuggaggacagccacaacggcaagcugugcagacugaagggcaucgccccccugcagcugggcaagugcagcaucgccggcuggauccugggcaaccccgagugcgagagccuguucagcaagaagagcuggagcuacaucgccgagacccccaacagcgagaacggcaccugcuaccccggcuacuucgccgacuacgaggagcugagagagcagcugagcagcgugagcagcuucgagagauucgagaucuuccccaaggagagaagcuggcccaagcacaacgugaccagaggcgugaccgccagcugcagccacaagggcaagagcagcuucuacagaaaccugcuguggcugaccgagaagaacggcagcuaccccaaccugagcaagagcuacgugaacaacaaggagaaggaggugcuggugcuguggggcgugcaccaccccagcaacaucgagaaccagaagaccaucuacagaaaggagaacgccuacgugagcguggugagcagcaacuacaacagaagauucacccccgagaucgccgagagacccaaggugagagaccaggagggcagaaucaacuacuacuggacccugcuggagcccggcgacaccaucaucuucgaggccaacggcaaccugaucgcccccugguacgccuucgcccugagcagaggcuucggcagcggcaucaucaccagcaacgccagcauggacgagugcgacaccaagugccagaccccccagggcgccaucaacagcagccugcccuuccagaacgugcaccccgugaccaucggcgagugccccaaguacgugagaagcaccaagcugagaauggugaccggccugagaaacauccccagcauccagagcagaggccuguucggcgccaucgccggcuucaucgagggcggcuggaccggcaugaucgacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucaacaagcuggagaagagaauggagaaccugaacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacaacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154085 - RNA, 1701 nt, Artificial Sequence; identical to SEQ ID NO: 153286
  derived and/or modified sequence opt4 from hemagglutinin__InfluenzaA__ABO32656

SEQ ID NO: 154086 - RNA, 1701 nt, Artificial Sequence
  derived and/or modified sequence opt4 from hemagglutinin__InfluenzaA__ABO32667
augaagaccaucaucgcccugagcuacauccugugccugguguucgcccagaagcugcccggcaacgacaacagcaccgccacccugugccugggccaccacgccgugcccaacggcacccuggugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccacugcgacggcuuccagaacaaggagugggaccuguucguggagagaagcaaggccuacagcaacugcuaccccuacgacgugcccgacuacgccagccugagaagccugguggccagcagcggcacccuggaguucaacaacgagagcuucaacuggaccggcguggcccagaacggcaccagcagcgccugcaagagaagaagcaacaagagcuucuucagcagacugaacuggcugcaccagcugaaguacaaguaccccgcccugaacgugaccaugcccaacaacgagaaguucgacaagcuguacaucuggggcgugcaccaccccagcaccgacagcgaccagaucagccuguacgcccaggccagcggcagagugaccgugagcaccaagagaagccagcagaccgugauccccaacaucggcagcagacccugggugagagacgugagcagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaccggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154087 - RNA, 1698 nt, Artificial Sequence
  derived and/or modified sequence opt4 from hemagglutinin__InfluenzaA__ABO32678
augaaggugaagcugcuggugcugcugugcaccuucaccgccaccuacgccgacaccaucugcaucggcuaccacgccaacaacagcaccgacaccguggacaccgugcuggagaagaacgugaccgugacccacagcgugaaccugcuggaggacagccacaacggcaagcugugccugcugaagggcaucgccccccugcagcugggcaacugcagcguggccggcuggauccugggcaaccccgagugcgagcugcugaucagcaaggagagcuggagcuacaucguggagacccccaaccccgagaacggcaccugcuaccccggcuacuucgccgacuacgaggagcugagagagcagcugagcagcgugagcagcuucgagagauucgagaucuuccccaaggagagcagcuggcccaaccacaccgugaccggcgugagcgccagcugcagccacaacggcaagagcagcuucuacagaaaccugcuguggcugaccggcaagaacggccuguaccccaaccugagcaagagcuacgccaacaacaaggagaaggaggugcuggugcuguggggcgugcaccacccccccaacaucggcgaccagagagcccuguaccacaccgagaacgccuacgugagcguggugagcagccacuacagcagaagauucacccccgagaucgccaagagacccaaggugagagaccaggagggcagaaucaacuacuacuggacccugcuggagcccggcgacaccaucaucuucgaggccaacggcaaccugaucgcccccagauucgccuucgcccugagcagaggcuucggcagcggcaucaucaccagcaacgcccccauggacgagugcgacgccaagugccagaccccccagggcgccaucaacagcagccugcccuuccagaacgugcaccccgugaccaucggcgagugccccaaguacgugagaagcgccaagcugagaauggccaccggccugagaaacauccccagcauccagagcagaggccuguucggcgccaucgccggcuucaucgagggcggcuggaccggcaugguggacggcugguacggcuaccaccaccagaacgagcagggcagcggcuacgccgccgaccagaagagcacccagaacgccaucaacggcaucaccaacaaggugaacagcgugaucgagaagaugaacacccaguucaccgccgugggcaaggaguucagcaagcuggagagaagaauggagaaccugcacaagaagguggacgacggcuuccuggacaucuggaccuacaacgccgagcugcuggugcugcuggagaacgagagaacccuggacuuccacgacagcaacgugaagaaccuguacgagaaggugaagagccagcugaagaacaacgccaaggagaucggcaacggcugcuucgaguucuaccacaagugcaacgacgagugcauggagagcgugaagaacggcaccuacgacuaccccaaguacagcgaggagagcaagcugaacagagagaagaucgacggcgugaagcuggagagcaugggcguguaccagauccuggccaucuacagcaccguggccagcagccuggugcugcuggugagccugggcgccaucagcuucuggaugugcagcaacggcagccugcagugcagaaucugcaucuga

SEQ ID NO: 154088 - RNA, 1701 nt, Artificial Sequence
  derived and/or modified sequence opt4 from hemagglutinin__InfluenzaA__ABO32692
augaagaccaucaucgcccugagcuacauccugugccugguguucgcccagaagcugcccggcaacgacaacagcaccgccacccugugccugggccaccacgccgugcccaacggcaccaucgugaagaccaucaccaacgaccagaucgaggugaccaacgccaccgagcuggugcagagcagcagcaccggcggcaucugcgacagcccccaccagauccuggacggcgagaacugcacccugaucgacgcccugcugggcgacccccagugcgacggcuuccagaacaagaagugggaccuguucguggagagaagcaaggccuacagcaacugcuaccccuacgacgugcccgacuacgccagccugagaagccugguggccagcagcggcacccuggaguucaacaacgagagcuucaacuggaccggcgugacccagaacggcaccagcagcgccugcaagagaagaagcaacaacagcuucuucagcagacugaacuggcugacccaccugaaguucaaguaccccgcccugaacgugaccaugcccaacaacgagaaguucgacaagcuguacaucuggggcgugcaccaccccggcaccgacaacgaccagaucuuccuguacgcccaggccagcggcagaaucaccgugagcaccaagagaagccagcagaccgugauccccaacaucggcagcagacccagagugagaaacauccccagcagaaucagcaucuacuggaccaucgugaagcccggcgacauccugcugaucaacagcaccggcaaccugaucgcccccagaggcuacuucaagaucagaagcggcaagagcagcaucaugagaagcgacgcccccaucggcaagugcaacagcgagugcaucacccccaacggcagcauccccaacgacaagcccuuccagaacgugaacagaaucaccuacggcgccugccccagauacgugaagcagaacacccugaagcuggccaccggcaugagaaacgugcccgagaagcagaccagaggcaucuucggcgccaucgccggcuucaucgagaacggcugggagggcaugguggacggcugguacggcuucagacaccagaacagcgagggcaucggccaggccgccgaccugaagagcacccaggccgccaucaaccagaucaacggcaagcugaacagacugaucggcaagaccaacgagaaguuccaccagaucgagaaggaguucagcgagguggagggcagaauccaggaccuggagaaguacguggaggacaccaagaucgaccuguggagcuacaacgccgagcugcugguggcccuggagaaccagcacaccaucgaccugaccgacagcgagaugaacaagcuguucgagagaaccaagaagcagcugagagagaacgccgaggacaugggcaacggcugcuucaagaucuaccacaagugcgacaacgccugcaucggcagcaucagaaacggcaccuacgaccacgacguguacagagacgaggcccugaacaacagauuccagaucaagggcguggagcugaagagcggcuacaaggacuggauccuguggaucagcuucgccaucagcugcuuccugcugugcguggugcugcugggcuucaucaugugggccugccagaagggcaacaucagaugcaacaucugcaucuga

SEQ ID NO: 154089 - RNA, 1701 nt, Artificial Sequence; identical to SEQ ID NO: 153953
  derived and/or modified sequence opt4 from hemagglutinin__InfluenzaA__ABO32751
